(12) United States Patent
Rauch et al.

(10) Patent No.: US 11,814,620 B2
(45) Date of Patent: Nov. 14, 2023

(54) EFFECTOR PROTEINS AND METHODS OF USE

(71) Applicant: Mammoth Biosciences, Inc., Brisbane, CA (US)

(72) Inventors: Benjamin Julius Rauch, Oakland, CA (US); Aaron DeLoughery, San Francisco, CA (US); William Douglass Wright, Fairfield, CA (US); David Paez-Espino, Concord, CA (US); Clarissa Oriel Rhines, San Mateo, CA (US); Lucas Benjamin Harrington, San Francisco, CA (US); Wiputra Jaya Hartono, San Francisco, CA (US)

(73) Assignee: Mammoth Biosciences, Inc., Brisbane, CA (US)

(*) Notice: Subject to any disclaimer, the term of this patent is extended or adjusted under 35 U.S.C. 154(b) by 0 days.

(21) Appl. No.: 17/746,851

(22) Filed: May 17, 2022

(65) Prior Publication Data

US 2023/0068771 A1    Mar. 2, 2023

Related U.S. Application Data

(63) Continuation of application No. PCT/US2022/028568, filed on May 10, 2022.

(60) Provisional application No. 63/316,358, filed on Mar. 3, 2022, provisional application No. 63/290,600, filed on Dec. 16, 2021, provisional application No. 63/220,286, filed on Jul. 9, 2021, provisional application No. 63/220,137, filed on Jul. 9, 2021, provisional application No. 63/186,700, filed on May 10, 2021.

(51) Int. Cl.
    *C12N 9/22*      (2006.01)
    *C12N 15/11*     (2006.01)
    *C12N 15/10*     (2006.01)
    *C12N 15/113*    (2010.01)

(52) U.S. Cl.
    CPC .............. *C12N 15/111* (2013.01); *C12N 9/22* (2013.01); *C12N 15/102* (2013.01); *C12N 15/113* (2013.01); *C12N 2310/20* (2017.05)

(58) Field of Classification Search
    CPC ...... C12N 15/111; C12N 9/22; C12N 15/102; C12N 15/113; C12N 2310/20
    See application file for complete search history.

(56) References Cited

U.S. PATENT DOCUMENTS

| | | |
|---|---|---|
| 2016/0324987 A1 | 11/2016 | Wang et al. |
| 2020/0190494 A1 | 6/2020 | Hou et al. |
| 2020/0299768 A1 | 9/2020 | Doudna et al. |
| 2021/0130827 A1 | 5/2021 | Kim |
| 2021/0139874 A1 | 5/2021 | Hou et al. |
| 2021/0163908 A1 | 6/2021 | Hou et al. |
| 2021/0166783 A1 | 6/2021 | Shmakov et al. |
| 2021/0198330 A1 | 7/2021 | Liu et al. |
| 2023/0203481 A1 | 6/2023 | Grover et al. |

FOREIGN PATENT DOCUMENTS

| | | |
|---|---|---|
| EP | 3894550 A2 | 10/2021 |
| WO | WO 2010/075303 A1 | 7/2010 |
| WO | WO 2012/068627 A1 | 5/2012 |
| WO | WO 2017/070632 A2 | 4/2017 |
| WO | WO 2018/027078 A1 | 2/2018 |
| WO | WO 2018/035250 A1 | 2/2018 |
| WO | WO 2019/089820 A1 | 5/2019 |
| WO | WO 2019/226953 A1 | 11/2019 |
| WO | WO 2020/123887 A2 | 6/2020 |
| WO | WO 2021/041945 A2 | 3/2021 |
| WO | WO 2021/050571 A1 | 3/2021 |
| WO | WO 2021/062227 A2 | 4/2021 |
| WO | WO 2021/087246 A1 | 5/2021 |
| WO | WO 2021/163587 A1 | 8/2021 |
| WO | WO 2022/055998 A1 | 3/2022 |
| WO | WO 2022/056000 A1 | 3/2022 |
| WO | WO 2022/140572 A1 | 6/2022 |
| WO | WO 2023/004430 A1 | 1/2023 |
| WO | WO 2023/039378 A1 | 3/2023 |
| WO | WO 2023/059115 A1 | 4/2023 |
| WO | WO 2023/108025 A1 | 6/2023 |

OTHER PUBLICATIONS

Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Singh et al., Current Protein and Peptide Science 19(1):5-15, 2018.*
Sadowski et al., Current Opinion in Structural Biology 19:357-362, 2009.*
Altschul et al., "Gapped BLAST and PSI-BLAST: a new generation of protein database search programs," *Nucleic Acids Res.*, 25(17):3389-3402 (1997).
Benskey et al., "Basic Concepts in Viral Vector-Mediated Gene Therapy," *Methods Mol. Biol.*, 1937:3-26 (2019).
Chang et al., "The distribution of different classes of nuclear localization signals (NLSs) in diverse organisms and the utilization of the minor NLS-binding site inplantnuclear import factor importin-α," *Plant Signal Behav.*, 8(10):e25976 (2013).
Chen et al., "Programmable C:G to G:C genome editing with CRISPR-Cas9-directed base excision repair proteins," *Nat. Commun.*, 12:1384 (2021).
Chu et al., "Rationally Designed Base Editors for Precise Editing of the Sickle Cell Disease Mutation," *CRISPR J.*, 4(2):169-177 (2021).

(Continued)

*Primary Examiner* — Delia M Ramirez
(74) *Attorney, Agent, or Firm* — Greenberg Traurig, LLP

(57) ABSTRACT

Provided herein are compositions, systems, and methods comprising effector proteins and uses thereof. These effector proteins are shown to be active with guide RNAs and may be characterized as CRISPR-associated (Cas) proteins. Various compositions, systems, and methods of the present disclosure leverage the activities of these effector proteins for the modification, detection, and engineering of nucleic acids.

30 Claims, 22 Drawing Sheets
Specification includes a Sequence Listing.

(56) References Cited

OTHER PUBLICATIONS

Devereux et al., "A comprehensive set of sequence analysis programs for the VAX," *Nucleic Acids Res.*, 12(Pt 1):387-395 (1984).
Dong et al., "Genome-Wide Off-Target Analysis in CRISPR-Cas9 Modified Mice and Their Offspring", G3, 9(11): 3645-3651 (2019).
Gaudelli et al., "Programmable base editing of A•T to G•C in genomic DNA without DNA cleavage," *Nature*, 551(7681):464-471 (2017).
Ingusci et al., "Gene Therapy Tools for Brain Diseases," *Front. Pharmacol.*, 10:724 (2019).
Genome ID No. Ga0120382_100003969 [online],Joint Genome Institute, May 18, 2018 [retrieved on Aug. 27, 2020]. Retrieved from the Internet.
Genome ID No. Ga0120385_10007521 [online]. Joint Genome Institute, May 18, 2018 [retrieved on Jul. 19, 2020]. Retrieved from the Internet.
Genome ID No. Ga0120381_100000998 [online], Joint Genome Institute, May 18, 2018 [retrieved on Aug. 27, 2020]. Retrieved from the Internet.
Genome ID No. Ga0223825_125832682 [online], Joint Genome Institute, Nov. 21, 2017 [retrieved on Aug. 27, 2020]. Retrieved from the Internet.
Genome ID No. Ga0223826_100149291 [online], Joint Genome Institute, Nov. 21, 2017 [retrieved on Aug. 27, 2020]. Retrieved from the Internet.
Genome ID No. Ga0223845_115963326 [online], Joint Genome Institute, Nov. 21, 2017 [retrieved on Aug. 27, 2020]. Retrieved from the Internet.
Genome ID No. Ga0224423_100147064 [online], Joint Genome Institute, Nov. 21, 2017 [retrieved on Aug. 27, 2020]. Retrieved from the Internet.
Genome ID No. Ga0257072_1000042122 [online], Joint Genome Institute, Jan. 31, 2019 [retrieved on Aug. 27, 2020]. Retrieved from the Internet.
Genome ID No. Ga0256404_10118387 [online], Joint Genome Institute, Jun. 19, 2018 [retrieved on Aug. 27, 2020]. Retrieved from the Internet.
Genome ID No. Ga0256405_1000142541 [online], Joint Genome Institute, Jul. 17, 2018 [retrieved on Aug. 27, 2020]. Retrieved from the Internet.
Genome ID No. Ga0265298_100412983 [online], Joint Genome Institute, Oct. 9, 2018 [retrieved on Aug. 27, 2020]. Retrieved from the Internet.
Genome ID No. Ga0265298_100594053 [online], Joint Genome Institute, Oct. 9, 2018 [retrieved on Aug. 27, 2020]. Retrieved from the Internet.
Genome ID No. Ga0265298_100766002 [online], Joint Genome Institute, Oct. 9, 2018 [retrieved on Aug. 27, 2020]. Retrieved from the Internet.
Genome ID No. Ga0256407_100153288 [online], Joint Genome Institute, Oct. 13, 2018 [retrieved on Aug. 27, 2020]. Retrieved from the Internet.
Genome ID No. Ga0265299_100103993 [online], Joint Genome Institute, Oct. 13, 2018 [retrieved on Aug. 27, 2020]. Retrieved from the Internet.
Genome ID No. Ga0326511_100744382 [online], Joint Genome Institute, Jan. 29, 2019 [retrieved on Aug. 27, 2020]. Retrieved from the Internet.
Genome ID No. Ga0310691_100115497 [online], Joint Genome Institute, Feb. 2, 2019 [retrieved on Aug. 27, 2020]. Retrieved from the Internet.
Genome ID No. Ga0310691_100226955 [online], Joint Genome Institute, Feb. 2, 2019 [retrieved on Aug. 27, 2020]. Retrieved from the Internet.
Genome ID No. Ga0310695_100712681 [online], Joint Genome Institute, Feb. 3, 2019 [retrieved on Aug. 27, 2020]. Retrieved from the Internet.
Genome ID No. Ga0392372_0017629_509_1960 [online], Joint Genome Institute, Mar. 31, 2020 [retrieved on Aug. 27, 2020]. Retrieved from the Internet.
Genome ID No. Ga0394156_0000445_19509_20915 [online], Joint Genome Institute, Apr. 4, 2020 [retrieved on Jul. 19, 2020]. Retrieved from the Internet.
Genome ID No. Ga0394157_0003192_2025_3476 [online], Joint Genome Institute, Apr. 4, 2020 [retrieved on Jul. 19, 2020]. Retrieved from the Internet.
Genome ID No. Ga0394157_0012981_6775_8181 [online], Joint Genome Institute, Apr. 4, 2020 [retrieved on Aug. 27, 2020]. Retrieved from the Internet.
Genome Id No. Ga0394157_0018148_3559_4968 04 [retrieved on 2020-08-27]. Retrieved from the [online], Joint Genome Institute, Apr. 4, 2020[retrieved on Aug. 27, 2020]. Retrieved from the Internet.
Kim et al "Enhancement of target specificity , of CRISPR-Cas12a by using a chimeric DNA-RNA guide," *Nucleic Acids Res.*, 48(15):8601-8616 (2020).
Koblan et al., "Efficient C•G-to-G•C base editors developed using CRISPRi screens, target-library analysis, and machine learning," *Nat. Biotechnol.*, 1-16 (2021).
Koblan et al., "Improving cytidine and adenine base editors by expression optimization and ancestral reconstruction," Nat. Biotechnol., 36:848-846 (2018).
Komor et al., "Improved base excision repair inhibition and bacteriophage Mu Gam protein yields C:G-to-T:A base editors with higher efficiency and product purity," *Sci. Adv.*, 3(8):eaao4774 (2017).
Komor et al., "Programmable editing of a target base in genomic DNA without double-stranded DNA cleavage," *Nature*, 533(7603):420-424 (2016).
Kulemzin et al., "Design and analysis of stably integrated reporters for inducible transgene expression in human T cells and CAR NK-cell lines," BMC Med. Genomics, 12:44 (2019).
Kulkarni et al., "Lipid Nanoparticles Enabling Gene Therapies: From Concepts to Clinical Utility," *Nucl. Acid Ther.*, 28(3):146-157 (2018).
Kurt et al., "CRISPR C-to-G base editors for inducing targeted DNA transversions in human cells," Nat. Biotechnol., 39:41-46 (2021).
Ma et al., "A CRISPR-Based Screen Identifies Genes Essential for West-Nile-Virus-Induced Cell Death," *Cell Rep.*, 12(4):673-683 (2015).
Makarova et al., "An updated evolutionary classification of CRISPR-Cas systems," *Nat. Ref. Microbiol.*, 13(11):722-736 (2015).
Myers et al., "Optimal alignments in linear space," *Comput. Appl. Biosci.*, 4(1):11-17 (1988).
Naso et al., "Adeno-Associated Virus (AAV) as a Vector for Gene Therapy," *BioDrugs*, 31(4):317-334 (2017).
O'Hare et al., "Transformation of mouse fibroblasts to methotrexate resistance by a recombinant plasmid expressing a prokaryotic dihydrofolate reductase," *Proc. Natl. Acad. Sci. USA*, 78(3):1527-1531 (1981).
Panyam et al., "Biodegradable nanoparticles for drug and gene delivery to cells and tissue," *Adv. Drug Deliv. Rev.*, 64 (Supp):61-71 (2012).
Pearson et al., "Improved tools for biological sequence comparison," *Proc. Natl. Acad. Sci. USA*, 85(8):2444-2448 (1988).
Pearson, "Rapid and sensitive sequence comparison with FASTP and FASTA," *Methods Enzymol.*, 183:63-98 (1990).
Rees et al., "Base editing: precision chemistry on the genome and transcriptome of living cells," *Nat. Rev. Genet.*, 19(12):770-788 (2018).
Shmakov et al., "Diversity and evolution of class 2 CRISPR—Cas systems," *Nat. Rev. Microbiol.*, 13(3):169-182 (2017).
Sinha et al., "A systematic genome-wide mapping of oncogenic mutation selection during CRISPR-Cas9 genome editing," *Nature Comm.* 12:6512 (2021).
Smith et. al., "Production of human beta interferon in insect cells infected with a baculovirus expression vector," *Mol. Cell. Biol.*, 3(12):2156-2165 (1983).

(56) References Cited

OTHER PUBLICATIONS

Sundaresan et al., "RNA-Independent DNA Cleavage Activities of Cas9 and Cas12a," *Cell Rep.*, 21(13):3728-3739 (2017).
Takebe et al., "SR alpha promoter: an efficient and versatile mammalian cDNA expression system composed of the simian virus 40 early promoter and the R-U5 segment of human T-cell leukemia virus type 1 long terminal repeat," *Mol. Cell. Biol.*, 8(1):466-472 (1988).
Tran et al., Engineering domain-inlaid SaCas9 adenine base editors with reduced RNA off-targets and increased on-target DNA editing, *Nat. Commun.*, 11:4871 (2020).
Tuladhar et al., "CRISPR-Cas9-based mutagenesis frequently provokes on-target mRNA misregulation," *Nat. Commun.*, 10:4056 (2019).
Urabe et al., "Insect cells as a factory to produce adeno-associated virus type 2 vectors," *Hum. Gene. Ther.*, 13(16):1935-1943 (2002).
Wang et al., "Specificity profiling of CRISPR system reveals greatly enhanced off-target gene editing," *Scientific Reports*, 10:2269 (2020).
Wildin et al., "Functional dissection of the murine lck distal promoter," *J. Immunol.*, 155(3):1286-1295 (1995).
Winter et al., "Genome-wide CRISPR screen reveals novel host factors required for Staphylococcus aureus α-hemolysin-mediated toxicity," *Sci. Rep.*, 6:24242 (2016).
Zhao et al., "Glycosylase base editors enable C-to-A and C-to-G base changes," *Nat. Biotechnol.*, 39:35-40 (2021).
U.S. Appl. No. 18/053,328, filed Nov. 7, 2022, Grover et al.
Xu et al., "Engineered miniature CRISPR-Cas system for mammalian genome regulation and editing," *Mol Cell.*, 81:1-13 (2021).

\* cited by examiner

Group 2

Group 10
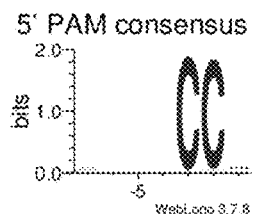
M274429
R5726
R5783
(NCCN)
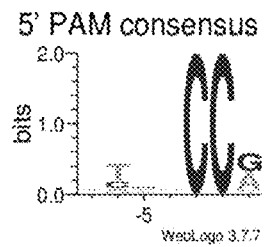
M19548
R5800
(NCCR, NCCN)
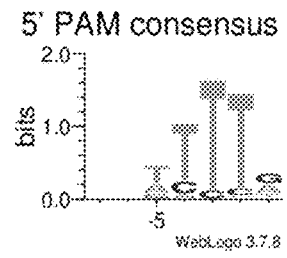
M281050
R5728
R5788
(TTTTR, TTTR)
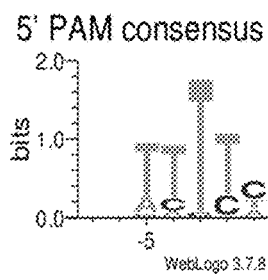
M19910
R5728
R5786
(TTTYY)
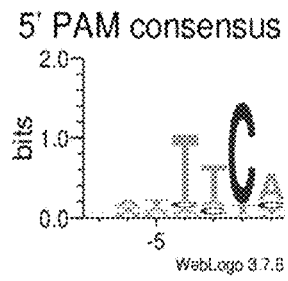
M295201
R5730
R5792
(TTCR)
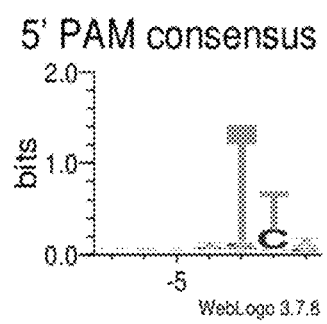
M293203
R7620
(NTYN)
FIG. 7C

Group 5
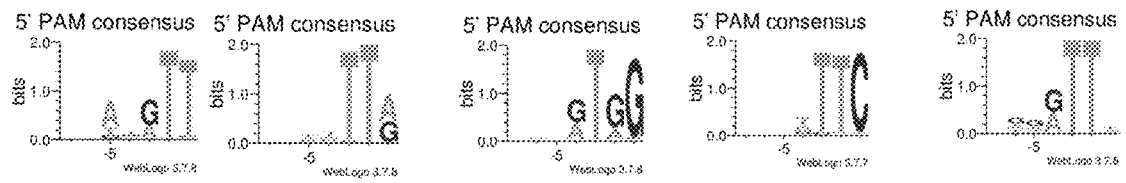
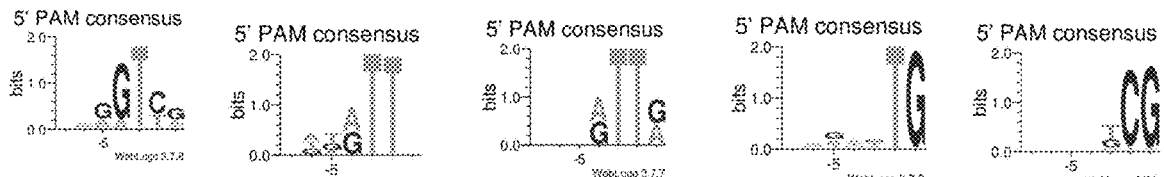
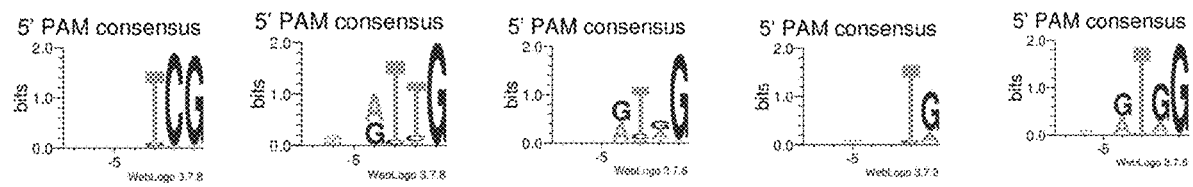
FIG. 7D

Group 5 cont.
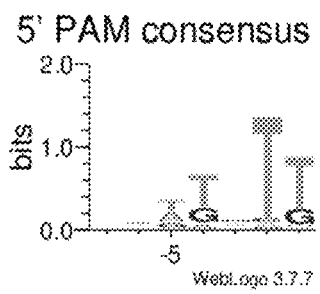
M292139
R4882
(TNTK)
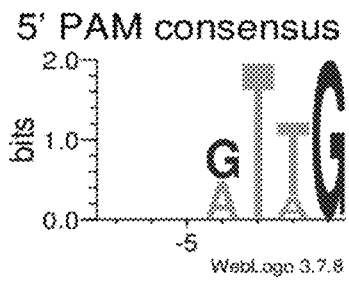
M272451
R5838
(RTTR)
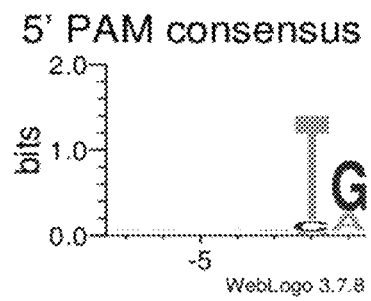
M294190
R5874
(NNTG,
NNTR)
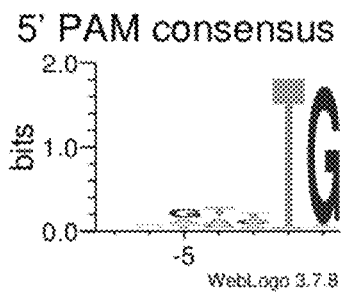
M288712
R5698
R5832
(NNTG)
FIG. 7D Cont.

Group 1
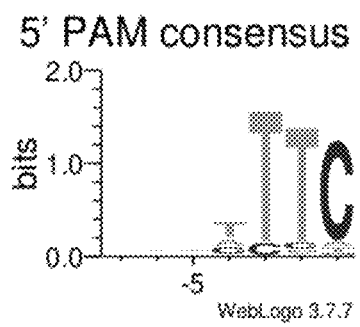
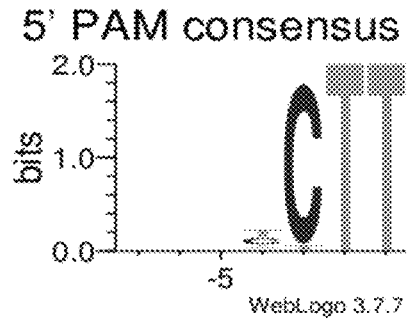
M294270  M298706
R4845   R4879
R5946   R4935
(NTTC)  (NCTT)
FIG. 7E

| | Effectors Tested | Linker Extension | Effector Plasmid Design |
|---|---|---|---|
| C Term | AncBE4Max APOBEC3 ABE8e ABE8.20m | XTEN10-N XTEN40-N XTEN80-N | NLS — dCasM.19952 — NLS — CBE/ABE — t2A — tagBFP (XTEN10/40/80) |
| N Term | AncBE4Max APOBEC3 ABE8e ABE8.20m | XTEN10-N XTEN40-N XTEN80-N | CBE/ABE — NLS — dCasM.19952 — NLS — t2A — tagBFP (XTEN10/40/80) |

| gRNA Target Sites (Indel %) |
|---|
| B2M_t5 (45.5%) |
| CIITA_t1 (27.4%) |
| CIITA_t12 (17.5%) |
| CIITA_t19 (12.3%) |
| CIITA_t26 (24.0%) |
| CIITA_t6 (13.4%) |
| CIITA_t9 (14.4%) |
| TRAC_t1 (14.0%) |
| TRAC_t3 (26.1%) |
| TRAC_t6 (13.1%) |
| B2M_t5 (45.5%) |
| CIITA_t12 (17.5%) |
| CIITA_t15 (25.3%) |
| CIITA_t19 (12.3%) |
| CIITA_t20 (10.0%) |
| CIITA_t26 (24.0%) |
| CIITA_t6 (13.4%) |
| CIITA_t9 (14.4%) |
| TRAC_t1 (14.0%) |
| NGCG_B2M_t3 (33.6) |

FIG. 9

MEME_1 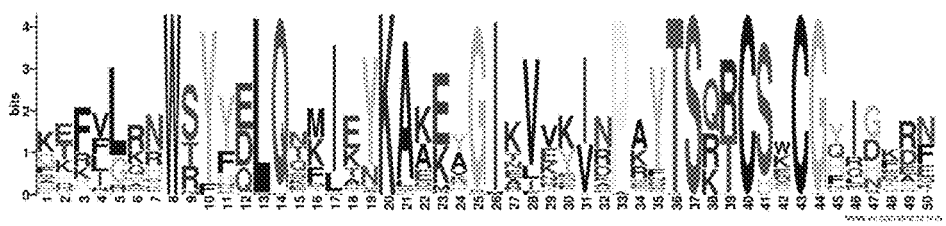
MEME_2 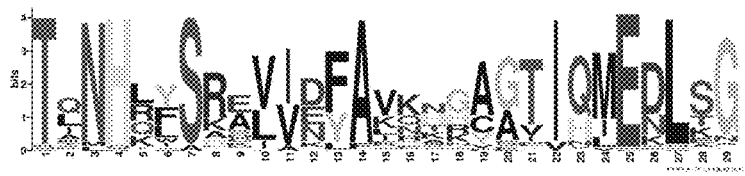
MEME_3 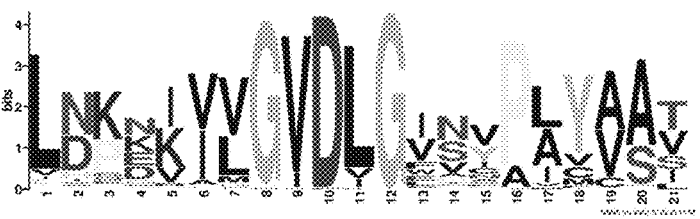
MEME_4 
MEME_5 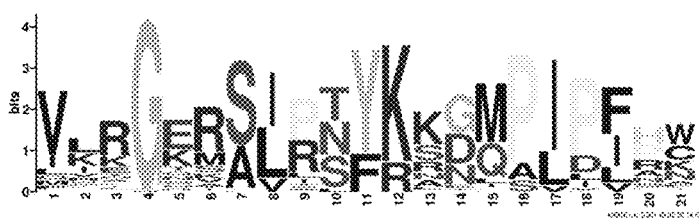
MEME_6 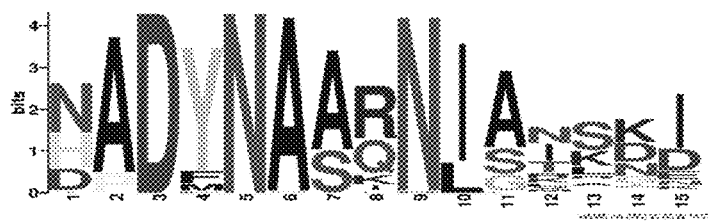
MEME_7 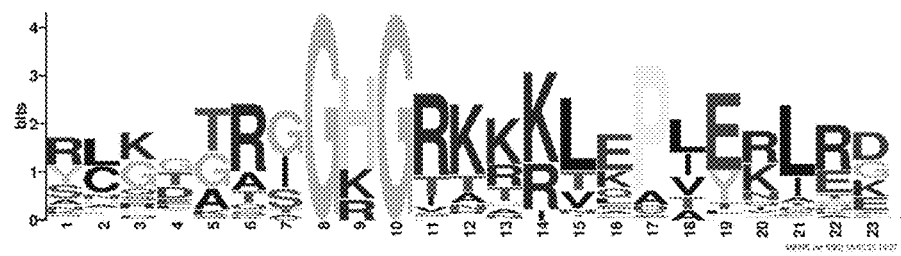
FIG. 11A

| Name | p-value | Motif Locations |
|---|---|---|
| CasM.298706 | 7.26e-101 | |
| CasM.280604 | 7.35e-91 | |
| CasM.281060 | 2.61e-105 | |
| CasM.284933 | 1.52e-105 | |
| CasM.287908 | 2.48e-104 | |
| CasM.288518 | 4.15e-103 | |
| CasM.293891 | 2.37e-102 | |
| CasM.294270 | 1.65e-103 | |
| CasM.294491 | 1.42e-104 | |
| CasM.295047 | 5.15e-106 | |
| CasM.299588 | 1.85e-92 | |
| CasM.277328 | 2.59e-98 | |
| CasM.297894 | 1.43e-100 | |
| CasM.291449 | 2.47e-95 | |
| CasM.297599 | 3.71e-108 | |
| CasM.286588 | 1.50e-96 | |
| CasM.286910 | 1.38e-109 | |
| CasM.292335 | 3.47e-97 | |
| CasM.293576 | 4.86e-108 | |
| CasM.294537 | 1.96e-109 | |
| CasM.298538 | 1.20e-104 | |
| CasM.19924 | 1.60e-122 | |
| CasM.19952 | 1.42e-181 | |

FIG. 11B

| Name | p-value |
|---|---|
| CasM.274559 | 2.39e-180 |
| CasM.286251 | 3.81e-182 |
| CasM.288480 | 1.58e-180 |
| CasM.288668 | 1.06e-169 |
| CasM.289206 | 1.38e-181 |
| CasM.290598 | 1.62e-179 |
| CasM.290816 | 2.93e-169 |
| CasM.295071 | 5.33e-182 |
| CasM.295231 | 3.57e-167 |
| CasM.292139 | 1.83e-121 |
| CasM.279423 | 6.58e-172 |
| CasM.20054 | 4.55e-101 |
| CasM.282673 | 8.22e-101 |
| CasM.282952 | 6.12e-106 |
| CasM.283262 | 8.67e-109 |
| CasM.284833 | 1.22e-111 |
| CasM.287700 | 4.72e-108 |
| CasM.291507 | 1.54e-111 |
| CasM.293410 | 1.00e-103 |
| CasM.295105 | 1.43e-108 |
| CasM.295187 | 7.39e-104 |
| CasM.295929 | 4.11e-104 |

FIG. 11B continued

| Name | p-value | Motif Locations |
|---|---|---|
| CasM.19498 | 4.48e-180 | |
| CasM.19548 | 7.46e-106 | |
| CasM.19910 | 5.42e-107 | |
| CasM.19948 | 1.08e-178 | |
| CasM.265291 | 8.11e-119 | |
| CasM.270012 | 1.19e-176 | |
| CasM.272451 | 1.95e-180 | |
| CasM.274429 | 3.18e-112 | |
| CasM.277378 | 1.23e-111 | |
| CasM.280852 | 9.19e-64 | |
| CasM.281050 | 1.12e-105 | |
| CasM.285333 | 1.76e-147 | |
| CasM.286285 | 9.64e-24 | |
| CasM.286678 | 2.82e-159 | |
| CasM.287128 | 6.72e-158 | |
| CasM.287826 | 3.18e-181 | |
| CasM.287896 | 5.01e-101 | |
| CasM.287936 | 4.93e-181 | |
| CasM.288450 | 2.01e-168 | |
| CasM.288712 | 5.65e-118 | |
| CasM.289248 | 1.28e-179 | |
| CasM.289726 | 1.83e-25 | |

FIG. 11B continued

EFFECTOR PROTEINS AND METHODS OF USE

CROSS REFERENCE TO RELATED APPLICATIONS

This application is a continuation of International Patent Application No. PCT/US22/28568, filed May 10, 2022, which claims the benefit of U.S. Provisional Application No. 63/186,700, filed May 10, 2021, U.S. Provisional Application No. 63/220,137, filed Jul. 9, 2021, U.S. Provisional Application No. 63/220,286, filed Jul. 9, 2021, U.S. Provisional Application No. 63/290,600, filed Dec. 16, 2021, and U.S. Provisional Application No. 63/316,358, filed Mar. 3, 2022, the disclosures of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Aug. 25, 2023, is named 203477-709201_US_SL.txt and is 909,066 bytes in size.

BACKGROUND

Programmable nucleases are proteins that bind and cleave nucleic acids in a sequence-specific manner. A programmable nuclease may bind a target region of a nucleic acid and cleave the nucleic acid within the target region or at a position adjacent to the target region. In some instances, a programmable nuclease is activated when it binds a target region of a nucleic acid to cleave regions of the nucleic acid that are near, but not adjacent to the target region. A programmable nuclease, such as a CRISPR-associated (Cas) protein, may be coupled to a guide nucleic acid that imparts activity or sequence selectivity to the programmable nuclease. In general, guide nucleic acids comprise a CRISPR RNA (crRNA) that is at least partially complementary to a target nucleic acid. In some cases, guide nucleic acids comprise a trans-activating crRNA (tracrRNA), at least a portion of which interacts with the programmable nuclease. In some cases, guide nucleic acids comprise a repeat region or a handle region, at least a portion of which interacts with the programmable nuclease, wherein a handle region comprises at least a portion of a repeat region. In some cases, a tracrRNA or intermediary RNA is provided separately from the guide nucleic acid. The tracrRNA, repeat region, handle region, or any combination thereof may hybridize to a portion of the guide nucleic acid that does not hybridize to the target nucleic acid.

Programmable nucleases may cleave nucleic acids, including single stranded RNA (ssRNA), double stranded DNA (dsDNA), and single-stranded DNA (ssDNA). Programmable nucleases may provide cis cleavage activity, trans cleavage activity, nickase activity, or a combination thereof. Cis cleavage activity is cleavage of a target nucleic acid that is hybridized to a guide RNA (crRNA or sgRNA), wherein cleavage occurs within or directly adjacent to the region of the target nucleic acid that is hybridized to guideRNA. Trans cleavage activity (also referred to as transcollateral cleavage) is cleavage of ssDNA or ssRNA that is near, but not hybridized to the guide RNA. Trans cleavage activity is triggered by the hybridization of guide RNA to the target nucleic acid. Nickase activity is the selective cleavage of one strand of a dsDNA molecule. While certain programmable nucleases may be used to edit and detect nucleic acid molecules in a sequence specific manner, challenging biological sample conditions (e.g., high viscosity, metal chelating) may limit their accuracy and effectiveness. There is thus a need for systems and methods that employ programmable nucleases having specificity and efficiency across a wide range of sample conditions.

SUMMARY

The present disclosure provides compositions, systems, and methods comprising effector protein and uses thereof. In general, the effector proteins are DNA modifying, are dual-guided (require a crRNA and tracrRNA, or a single guide RNA comprising portions of each, for activity), and are short (less than 700 linked amino acids in length). Thus, they are referred to herein as D2S effector proteins. Compositions, systems and methods disclosed herein leverage the nucleic acid modifying activities (e.g., cis cleavage activity and trans-collateral cleavage activity) of these D2S effector proteins for the modification, detection and engineering of target nucleic acids.

While other short, also referred to as "compact," effectors may be known in the art, these D2S effectors are particularly compact, the majority being less than 500 amino acids in length, and several being less than 400 amino acids in length. This makes them particularly useful for delivery via viral vectors (e.g., AAV), where additional CRISPR system components, (e.g., guide RNA(s), donor nucleic acid, and promoters), may be incorporated into the same viral vector, thereby enabling more efficient viral production. Small size is especially useful for self-complementary AAV (scAAV) systems which have a very limited cargo size. In addition to their compact nature, they provide the ability to modify additional or alternative sequences relative to known effectors, due to their ability to recognize a variety of protospacer adjacent motifs (PAMs), see, e.g., Table 35. Many of the D2S effectors disclosed herein have high identity and similarity to CasM.19952, which has demonstrated "blunt" cutting, and may also provide blunt or short stagger cut ends. Blunt cutting may be advantageous over the staggered cutting that is provided by other nucleases, as there is a less likely chance of spontaneous (also referred to as perfect) repair which may decrease the chances of successful target modification and/or donor insertion.

I. Certain Embodiments

Provided herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 1.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 2.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 3.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 4.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 5.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 6.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 7.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 8.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 9.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 10.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 11.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 12.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 13.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 14.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 15.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 16.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 17.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 18.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 19.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 20.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 21.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 22.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 24.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 25.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 26.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 27.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 28.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 29.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 30.

Also provided herein, is a composition comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 31.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 32.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 33.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 34.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 35.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 36.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 37.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 38.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 39.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 40.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 41.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 42.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 43.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 44.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 45.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 202.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 203.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 204.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 205.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 206.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 207.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 208.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 209.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 210.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 211.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 212.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 213.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 214.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 215.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 216.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 217.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 218.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 219.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 220.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 221.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 222.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 223.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 224.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 225.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 226.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 227.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 228.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 229.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 230.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 231.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 232.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 233.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 234.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 235.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 236.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 237.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 238.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 239.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 240.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 728.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 729.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 730.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 731.

Also provided herein, are compositions comprising an effector protein and an engineered guide nucleic acid, wherein the amino acid sequence of the effector protein comprises one or more amino acid alteration.

Also provided herein, are compositions comprising an effector protein and an engineered guide nucleic acid, wherein the amino acid sequence of the effector protein comprises one or more amino acid alteration in one or more domain comprising a REC domain, RuvC-I domain, or a RuvC-II domain.

Also provided herein, are compositions comprising an effector protein and an engineered guide nucleic acid, wherein the amino acid sequence of the effector protein comprises: one or more amino acid alteration at a position corresponding to 110, 111, 112, 113, 114, 115, 116, 117, 118, 119, 122, 123, 124, 125, 126, 127, 128, 129, 130, 131, or 132 in a REC domain; one or more amino acid alteration at a position corresponding to 261, 263, 264, 265, 266, 267, 268, 269, 270, 271, 272, 273, 274, 275, 276, 277, 278, 279, 280, 281 or 282 in a RuvC-I domain; one or more amino acid alteration at a position corresponding to 457, 458, 459, 460, 461, 462, 463, 464, 466, 467 or 468 in a RuvC-II domain; or any combination thereof.

Also provided herein, are compositions comprising an effector protein and an engineered guide nucleic acid, wherein the amino acid sequence of the effector protein comprises one or more amino acid alteration: T115R, T124R, L126R, E127R, T128R, N129R, or A132R in a REC domain; K261R, V263R, T278R, T281R, or E282R in a RuvC-I domain; N459R, S460R, D462R, K466R, N467R, or E468R in a RuvC-II domain; or any combination thereof.

Also provided herein, are compositions comprising an effector protein and an engineered guide nucleic acid, wherein the amino acid sequence of the effector protein comprises one or more amino acid alteration at a position corresponding to one or more residue A110, T111, E112, M113, S114, T115, Q116, S117, L118, S119, F122, A123, T124, E125, L126, E127, T128, N129, I130, F131, A132, K261, V263, V264, G265, V266, D267, L268, G269, I270, N271, V272, P273, A274, Y275, V276, A277, T278, N279, I280, T281, E282, E363, I457, A458, N459, S460, K461, D462, I463, I464, K466, N467, E468, or any combination thereof.

Also provided herein, are compositions comprising an effector protein and an engineered guide nucleic acid, wherein the effector protein amino acid sequence comprises one or more amino acid alteration comprising one or more of A110R, T111R, E112R, M113R, S114R, T115R, Q116R, S117R, L118R, S119R, F122R, A123R, T124R, E125R, L126R, E127R, T128R, N129R, I130R, F131R, A132R, K261R, V263R, V264R, G265R, V266R, D267R, D267A, D267N, L268R, G269R, I270R, N271R, V272R, P273R, A274R, Y275R, V276R, A277R, T278R, N279R, I280R, T281R, E282R, E363Q, I457R, A458R, N459R, S460R, K461R, D462R, I463R, I464R, K466R, N467R, E468R or any combination thereof.

Also provided herein, are compositions comprising an effector protein and an engineered guide nucleic acid, wherein the effector protein amino acid sequence comprises one or more amino acid alteration comprising one or more of D267A, E363Q, or both.

Also provided herein, are compositions comprising an effector protein and an engineered guide nucleic acid, wherein the effector protein amino acid sequence comprises one or more amino acid alteration comprising one or more of D267N, E363Q, or both.

Also provided herein, are compositions comprising an effector protein and an engineered guide nucleic acid, wherein the effector protein amino acid sequence comprises one or more amino acid alteration comprising one or more of T115R, T124R, L126R, E127R, T128R, N129R, A132R, K261R, V263R, T278R, T281R, E282R, N459R, S460R, D462R, K466R, N467R, E468R or any combination thereof.

Also provided herein, are compositions comprising an effector protein and an engineered guide nucleic acid, wherein the effector protein amino acid sequence comprises one or more amino acid alteration comprising one or more of T124R, T128R, N129R, T278R, E282R, T281R, or any combination thereof.

Also provided herein, are compositions comprising an effector protein and an engineered guide nucleic acid, wherein the amino acid sequence of the effector protein comprises a T124R, T128R or N129R amino acid alteration.

Also provided herein, are compositions comprising an effector protein and an engineered guide nucleic acid, wherein the amino acid sequence of the effector protein comprises a T278R, E282R, or T281R amino acid alteration.

Also provided herein, are compositions comprising an effector protein and an engineered guide nucleic acid, wherein the amino acid sequence of the effector protein, other than a A110R amino acid alteration, is at least 75%, at least 80%, at least 85%, at least 90%, at least 95%, at least 98%, at least 99% or 100% identical to SEQ ID NO: 241.

Also provided herein, are compositions comprising an effector protein and an engineered guide nucleic acid, wherein the amino acid sequence of the effector protein, other than a T111R amino acid alteration, is at least 75%, at least 80%, at least 85%, at least 90%, at least 95%, at least 98%, at least 99% or 100% identical to SEQ ID NO: 242.

Also provided herein, are compositions comprising an effector protein and an engineered guide nucleic acid, wherein the amino acid sequence of the effector protein, other than a E112R amino acid alteration, is at least 75%, at least 80%, at least 85%, at least 90%, at least 95%, at least 98%, at least 99% or 100% identical to SEQ ID NO: 243.

Also provided herein, are compositions comprising an effector protein and an engineered guide nucleic acid, wherein the amino acid sequence of the effector protein, other than a M113R amino acid alteration, is at least 75%, at least 80%, at least 85%, at least 90%, at least 95%, at least 98%, at least 99% or 100% identical to SEQ ID NO: 244.

Also provided herein, are compositions comprising an effector protein and an engineered guide nucleic acid, wherein the amino acid sequence of the effector protein, other than a S114R amino acid alteration, is at least 75%, at least 80%, at least 85%, at least 90%, at least 95%, at least 98%, at least 99% or 100% identical to SEQ ID NO: 245.

Also provided herein, are compositions comprising an effector protein and an engineered guide nucleic acid, wherein the amino acid sequence of the effector protein, other than a T115R amino acid alteration, is at least 75%, at least 80%, at least 85%, at least 90%, at least 95%, at least 98%, at least 99% or 100% identical to SEQ ID NO: 246.

Also provided herein, are compositions comprising an effector protein and an engineered guide nucleic acid, wherein the amino acid sequence of the effector protein, other than a Q116R amino acid alteration, is at least 75%, at least 80%, at least 85%, at least 90%, at least 95%, at least 98%, at least 99% or 100% identical to SEQ ID NO: 247.

Also provided herein, are compositions comprising an effector protein and an engineered guide nucleic acid, wherein the amino acid sequence of the effector protein, other than a S117R amino acid alteration, is at least 75%, at least 80%, at least 85%, at least 90%, at least 95%, at least 98%, at least 99% or 100% identical to SEQ ID NO: 248.

Also provided herein, are compositions comprising an effector protein and an engineered guide nucleic acid, wherein the amino acid sequence of the effector protein, other than a L118R amino acid alteration, is at least 75%, at least 80%, at least 85%, at least 90%, at least 95%, at least 98%, at least 99% or 100% identical to SEQ ID NO: 249.

Also provided herein, are compositions comprising an effector protein and an engineered guide nucleic acid, wherein the amino acid sequence of the effector protein, other than a S119R amino acid alteration, is at least 75%, at least 80%, at least 85%, at least 90%, at least 95%, at least 98%, at least 99% or 100% identical to SEQ ID NO: 250.

Also provided herein, are compositions comprising an effector protein and an engineered guide nucleic acid, wherein the amino acid sequence of the effector protein, other than a F122R amino acid alteration, is at least 75%, at least 80%, at least 85%, at least 90%, at least 95%, at least 98%, at least 99% or 100% identical to SEQ ID NO: 251.

Also provided herein, are compositions comprising an effector protein and an engineered guide nucleic acid, wherein the amino acid sequence of the effector protein, other than a A123R amino acid alteration, is at least 75%, at least 80%, at least 85%, at least 90%, at least 95%, at least 98%, at least 99% or 100% identical to SEQ ID NO: 252.

Also provided herein, are compositions comprising an effector protein and an engineered guide nucleic acid, wherein the amino acid sequence of the effector protein, other than a T124R amino acid alteration, is at least 75%, at least 80%, at least 85%, at least 90%, at least 95%, at least 98%, at least 99% or 100% identical to SEQ ID NO: 253.

Also provided herein, are compositions comprising an effector protein and an engineered guide nucleic acid, wherein the amino acid sequence of the effector protein, other than a E125R amino acid alteration, is at least 75%, at least 80%, at least 85%, at least 90%, at least 95%, at least 98%, at least 99% or 100% identical to SEQ ID NO: 254.

Also provided herein, are compositions comprising an effector protein and an engineered guide nucleic acid, wherein the amino acid sequence of the effector protein, other than a L126R amino acid alteration, is at least 75%, at least 80%, at least 85%, at least 90%, at least 95%, at least 98%, at least 99% or 100% identical to SEQ ID NO: 255.

Also provided herein, are compositions comprising an effector protein and an engineered guide nucleic acid, wherein the amino acid sequence of the effector protein, other than a E127R amino acid alteration, is at least 75%, at least 80%, at least 85%, at least 90%, at least 95%, at least 98%, at least 99% or 100% identical to SEQ ID NO: 256.

Also provided herein, are compositions comprising an effector protein and an engineered guide nucleic acid, wherein the amino acid sequence of the effector protein, other than a T128R amino acid alteration, is at least 75%, at least 80%, at least 85%, at least 90%, at least 95%, at least 98%, at least 99% or 100% identical to SEQ ID NO: 257.

Also provided herein, are compositions comprising an effector protein and an engineered guide nucleic acid, wherein the amino acid sequence of the effector protein, other than a N129R amino acid alteration, is at least 75%, at least 80%, at least 85%, at least 90%, at least 95%, at least 98%, at least 99% or 100% identical to SEQ ID NO: 258.

Also provided herein, are compositions comprising an effector protein and an engineered guide nucleic acid, wherein the amino acid sequence of the effector protein, other than a 1130R amino acid alteration, is at least 75%, at least 80%, at least 85%, at least 90%, at least 95%, at least 98%, at least 99% or 100% identical to SEQ ID NO: 259.

Also provided herein, are compositions comprising an effector protein and an engineered guide nucleic acid, wherein the amino acid sequence of the effector protein, other than a F131R amino acid alteration, is at least 75%, at least 80%, at least 85%, at least 90%, at least 95%, at least 98%, at least 99% or 100% identical to SEQ ID NO: 260.

Also provided herein, are compositions comprising an effector protein and an engineered guide nucleic acid, wherein the amino acid sequence of the effector protein, other than a A132R amino acid alteration, is at least 75%, at least 80%, at least 85%, at least 90%, at least 95%, at least 98%, at least 99% or 100% identical to SEQ ID NO: 261.

Also provided herein, are compositions comprising an effector protein and an engineered guide nucleic acid, wherein the amino acid sequence of the effector protein, other than a K261R amino acid alteration, is at least 75%, at least 80%, at least 85%, at least 90%, at least 95%, at least 98%, at least 99% or 100% identical to SEQ ID NO: 262.

Also provided herein, are compositions comprising an effector protein and an engineered guide nucleic acid, wherein the amino acid sequence of the effector protein, other than a V263R amino acid alteration, is at least 75%, at least 80%, at least 85%, at least 90%, at least 95%, at least 98%, at least 99% or 100% identical to SEQ ID NO: 263.

Also provided herein, are compositions comprising an effector protein and an engineered guide nucleic acid, wherein the amino acid sequence of the effector protein, other than a V264R amino acid alteration, is at least 75%, at least 80%, at least 85%, at least 90%, at least 95%, at least 98%, at least 99% or 100% identical to SEQ ID NO: 264.

Also provided herein, are compositions comprising an effector protein and an engineered guide nucleic acid, wherein the amino acid sequence of the effector protein, other than a G265R amino acid alteration, is at least 75%, at least 80%, at least 85%, at least 90%, at least 95%, at least 98%, at least 99% or 100% identical to SEQ ID NO: 265.

Also provided herein, are compositions comprising an effector protein and an engineered guide nucleic acid, wherein the amino acid sequence of the effector protein, other than a V266R amino acid alteration, is at least 75%, at least 80%, at least 85%, at least 90%, at least 95%, at least 98%, at least 99% or 100% identical to SEQ ID NO: 266.

Also provided herein, are compositions comprising an effector protein and an engineered guide nucleic acid, wherein the amino acid sequence of the effector protein, other than a D267R amino acid alteration, is at least 75%, at least 80%, at least 85%, at least 90%, at least 95%, at least 98%, at least 99% or 100% identical to SEQ ID NO: 267.

Also provided herein, are compositions comprising an effector protein and an engineered guide nucleic acid, wherein the amino acid sequence of the effector protein, other than a L268R amino acid alteration, is at least 75%, at least 80%, at least 85%, at least 90%, at least 95%, at least 98%, at least 99% or 100% identical to SEQ ID NO: 268.

Also provided herein, are compositions comprising an effector protein and an engineered guide nucleic acid, wherein the amino acid sequence of the effector protein, other than a G269R amino acid alteration, is at least 75%, at least 80%, at least 85%, at least 90%, at least 95%, at least 98%, at least 99% or 100% identical to SEQ ID NO: 269.

Also provided herein, are compositions comprising an effector protein and an engineered guide nucleic acid, wherein the amino acid sequence of the effector protein, other than a 1270R amino acid alteration, is at least 75%, at least 80%, at least 85%, at least 90%, at least 95%, at least 98%, at least 99% or 100% identical to SEQ ID NO: 270.

Also provided herein, are compositions comprising an effector protein and an engineered guide nucleic acid, wherein the amino acid sequence of the effector protein, other than a N271R amino acid alteration, is at least 75%, at least 80%, at least 85%, at least 90%, at least 95%, at least 98%, at least 99% or 100% identical to SEQ ID NO: 271.

Also provided herein, are compositions comprising an effector protein and an engineered guide nucleic acid, wherein the amino acid sequence of the effector protein, other than a V272R amino acid alteration, is at least 75%, at least 80%, at least 85%, at least 90%, at least 95%, at least 98%, at least 99% or 100% identical to SEQ ID NO: 272.

Also provided herein, are compositions comprising an effector protein and an engineered guide nucleic acid, wherein the amino acid sequence of the effector protein, other than a P273R amino acid alteration, is at least 75%, at least 80%, at least 85%, at least 90%, at least 95%, at least 98%, at least 99% or 100% identical to SEQ ID NO: 273.

Also provided herein, are compositions comprising an effector protein and an engineered guide nucleic acid, wherein the amino acid sequence of the effector protein, other than a A274R amino acid alteration, is at least 75%, at least 80%, at least 85%, at least 90%, at least 95%, at least 98%, at least 99% or 100% identical to SEQ ID NO: 274.

Also provided herein, are compositions comprising an effector protein and an engineered guide nucleic acid, wherein the amino acid sequence of the effector protein, other than a Y275R amino acid alteration, is at least 75%, at least 80%, at least 85%, at least 90%, at least 95%, at least 98%, at least 99% or 100% identical to SEQ ID NO: 275.

Also provided herein, are compositions comprising an effector protein and an engineered guide nucleic acid, wherein the amino acid sequence of the effector protein, other than a V276R amino acid alteration, is at least 75%, at least 80%, at least 85%, at least 90%, at least 95%, at least 98%, at least 99% or 100% identical to SEQ ID NO: 276.

Also provided herein, are compositions comprising an effector protein and an engineered guide nucleic acid, wherein the amino acid sequence of the effector protein, other than a A277R amino acid alteration, is at least 75%, at least 80%, at least 85%, at least 90%, at least 95%, at least 98%, at least 99% or 100% identical to SEQ ID NO: 277.

Also provided herein, are compositions comprising an effector protein and an engineered guide nucleic acid, wherein the amino acid sequence of the effector protein, other than a T278R amino acid alteration, is at least 75%, at least 80%, at least 85%, at least 90%, at least 95%, at least 98%, at least 99% or 100% identical to SEQ ID NO: 278.

Also provided herein, are compositions comprising an effector protein and an engineered guide nucleic acid, wherein the amino acid sequence of the effector protein, other than a N279R amino acid alteration, is at least 75%, at least 80%, at least 85%, at least 90%, at least 95%, at least 98%, at least 99% or 100% identical to SEQ ID NO: 279.

Also provided herein, are compositions comprising an effector protein and an engineered guide nucleic acid, wherein the amino acid sequence of the effector protein, other than a I280R amino acid alteration, is at least 75%, at least 80%, at least 85%, at least 90%, at least 95%, at least 98%, at least 99% or 100% identical to SEQ ID NO: 280.

Also provided herein, are compositions comprising an effector protein and an engineered guide nucleic acid, wherein the amino acid sequence of the effector protein, other than a T281R amino acid alteration, is at least 75%, at least 80%, at least 85%, at least 90%, at least 95%, at least 98%, at least 99% or 100% identical to SEQ ID NO: 281.

Also provided herein, are compositions comprising an effector protein and an engineered guide nucleic acid, wherein the amino acid sequence of the effector protein, other than a E282R amino acid alteration, is at least 75%, at least 80%, at least 85%, at least 90%, at least 95%, at least 98%, at least 99% or 100% identical to SEQ ID NO: 282.

Also provided herein, are compositions comprising an effector protein and an engineered guide nucleic acid, wherein the amino acid sequence of the effector protein, other than a I457R amino acid alteration, is at least 75%, at least 80%, at least 85%, at least 90%, at least 95%, at least 98%, at least 99% or 100% identical to SEQ ID NO: 283.

Also provided herein, are compositions comprising an effector protein and an engineered guide nucleic acid, wherein the amino acid sequence of the effector protein, other than a A458R amino acid alteration, is at least 75%, at least 80%, at least 85%, at least 90%, at least 95%, at least 98%, at least 99% or 100% identical to SEQ ID NO: 284.

Also provided herein, are compositions comprising an effector protein and an engineered guide nucleic acid, wherein the amino acid sequence of the effector protein, other than a N459R amino acid alteration, is at least 75%, at least 80%, at least 85%, at least 90%, at least 95%, at least 98%, at least 99% or 100% identical to SEQ ID NO: 285.

Also provided herein, are compositions comprising an effector protein and an engineered guide nucleic acid, wherein the amino acid sequence of the effector protein, other than a 5460R amino acid alteration, is at least 75%, at least 80%, at least 85%, at least 90%, at least 95%, at least 98%, at least 99% or 100% identical to SEQ ID NO: 286.

Also provided herein, are compositions comprising an effector protein and an engineered guide nucleic acid, wherein the amino acid sequence of the effector protein, other than a K461R amino acid alteration, is at least 75%, at least 80%, at least 85%, at least 90%, at least 95%, at least 98%, at least 99% or 100% identical to SEQ ID NO: 287.

Also provided herein, are compositions comprising an effector protein and an engineered guide nucleic acid, wherein the amino acid sequence of the effector protein, other than a D462R amino acid alteration, is at least 75%, at least 80%, at least 85%, at least 90%, at least 95%, at least 98%, at least 99% or 100% identical to SEQ ID NO: 288.

Also provided herein, are compositions comprising an effector protein and an engineered guide nucleic acid, wherein the amino acid sequence of the effector protein, other than a I463R amino acid alteration, is at least 75%, at least 80%, at least 85%, at least 90%, at least 95%, at least 98%, at least 99% or 100% identical to SEQ ID NO: 289.

Also provided herein, are compositions comprising an effector protein and an engineered guide nucleic acid, wherein the amino acid sequence of the effector protein, other than a I464R amino acid alteration, is at least 75%, at least 80%, at least 85%, at least 90%, at least 95%, at least 98%, at least 99% or 100% identical to SEQ ID NO: 290.

Also provided herein, are compositions comprising an effector protein and an engineered guide nucleic acid, wherein the amino acid sequence of the effector protein, other than a K466R amino acid alteration, is at least 75%, at least 80%, at least 85%, at least 90%, at least 95%, at least 98%, at least 99% or 100% identical to SEQ ID NO: 291.

Also provided herein, are compositions comprising an effector protein and an engineered guide nucleic acid, wherein the amino acid sequence of the effector protein, other than a N467R amino acid alteration, is at least 75%, at least 80%, at least 85%, at least 90%, at least 95%, at least 98%, at least 99% or 100% identical to SEQ ID NO: 292.

Also provided herein, are compositions comprising an effector protein and an engineered guide nucleic acid, wherein the amino acid sequence of the effector protein, other than a E468R amino acid alteration, is at least 75%, at least 80%, at least 85%, at least 90%, at least 95%, at least 98%, at least 99% or 100% identical to SEQ ID NO: 293.

Also provided herein, are compositions comprising an effector protein and an engineered guide nucleic acid, wherein the amino acid sequence of the effector protein, other than a D267A amino acid alteration, is at least 75%, at least 80%, at least 85%, at least 90%, at least 95%, at least 98%, at least 99% or 100% identical to SEQ ID NO: 728.

Also provided herein, are compositions comprising an effector protein and an engineered guide nucleic acid, wherein the amino acid sequence of the effector protein, other than a D267A amino acid alteration, is at least 75%, at least 80%, at least 85%, at least 90%, at least 95%, at least 98%, at least 99% or 100% identical to SEQ ID NO: 729.

Also provided herein, are compositions comprising an effector protein and an engineered guide nucleic acid, wherein the amino acid sequence of the effector protein, other than a D267N amino acid alteration, is at least 75%, at least 80%, at least 85%, at least 90%, at least 95%, at least 98%, at least 99% or 100% identical to SEQ ID NO: 730.

Also provided herein, are compositions comprising an effector protein and an engineered guide nucleic acid, wherein the amino acid sequence of the effector protein, other than a E363Q amino acid alteration, is at least 75%, at least 80%, at least 85%, at least 90%, at least 95%, at least 98%, at least 99% or 100% identical to SEQ ID NO: 731.

Also provided herein, are compositions comprising an effector protein and an engineered guide nucleic acid, wherein the effector protein comprises an amino acid sequence that is at least 75%%, at least 80%, at least 85%, at least 90%, at least 95%, at least 98%, at least 99% or 100% identical to any one of SEQ ID NOs: 1-13, and wherein the engineered guide nucleic acid comprises: (i) a crRNA comprising a nucleobase sequence that is at least 75%, at least 80%, at least 85%, at least 90%, at least 95%, or 100% identical to any one of SEQ ID NOs: 46-58, (ii) a tracrRNA comprising a nucleobase sequence that is at least 75%, at least 80%, at least 85%, at least 90%, at least 95%, or 100% identical to any one of SEQ ID NOs: 91-103, or (iii) a combination thereof.

Also provided herein, are compositions comprising an effector protein and an engineered guide nucleic acid, wherein the effector protein comprises an amino acid sequence that is at least 75%%, at least 80%, at least 85%, at least 90%, at least 95%, at least 98%, at least 99% or 100% identical to any one of SEQ ID NOs: 14-21, and wherein the engineered guide nucleic acid comprises: (i) a crRNA comprising a nucleobase sequence that is at least 75%, at least 80%, at least 85%, at least 90%, at least 95%, or 100% identical to any one of SEQ ID NOs: 59-66, (ii) a tracrRNA comprising a nucleobase sequence that is at least 75%, at least 80%, at least 85%, at least 90%, at least 95%, or 100% identical to any one of SEQ ID NOs: 104-119, or (iii) a combination thereof.

Also provided herein, are compositions comprising an effector protein and an engineered guide nucleic acid, wherein the effector protein comprises an amino acid sequence that is at least 75%%, at least 80%, at least 85%, at least 90%, at least 95%, at least 98%, at least 99% or 100% identical to any one of SEQ ID NOs: 22-34, and wherein the engineered guide nucleic acid comprises: (i) a crRNA comprising a nucleobase sequence that is at least 75%, at least 80%, at least 85%, at least 90%, at least 95%, or 100% identical to any one of SEQ ID NOs: 67-79, (ii) a tracrRNA comprising a nucleobase sequence that is at least 75%, at least 80%, at least 85%, at least 90%, at least 95%, or 100% identical to any one of SEQ ID NOs: 120-127, or (iii) a combination thereof.

Also provided herein, are compositions comprising an effector protein and an engineered guide nucleic acid, wherein the effector protein comprises an amino acid sequence that is at least 75%%, at least 80%, at least 85%, at least 90%, at least 95%, at least 98%, at least 99% or 100% identical to any one of SEQ ID NOs: 35-45, and wherein the engineered guide nucleic acid comprises: (i) a crRNA comprising a nucleobase sequence that is at least 75%, at least 80%, at least 85%, at least 90%, at least 95%, or 100% identical to any one of SEQ ID NOs: 80-90, (ii) a tracrRNA comprising a nucleobase sequence that is at least 75%, at least 80%, at least 85%, at least 90%, at least 95%, or 100% identical to any one of SEQ ID NOs: 128-148, or (iii) a combination thereof.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 1, wherein the engineered guide nucleic acid comprises: (i) a crRNA comprising a nucleobase sequence that is at least 75%, at least 80%, at least 85%, at least 90%, at least 95%, or 100% identical to SEQ ID NO: 46 and (ii) a tracrRNA comprising a nucleobase sequence that is at least 75%, at least 80%, at least 85%, at least 90%, at least 95%, or 100% identical to SEQ ID NO: 91.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 2, wherein the engineered guide nucleic acid comprises: (i) a crRNA comprising a nucleobase sequence that is at least 75%, at least 80%, at least 85%, at least 90%, at least 95%, or 100% identical to SEQ ID NO: 47 and (ii) a tracrRNA comprising a nucleobase sequence that is at least 75%, at least 80%, at least 85%, at least 90%, at least 95%, or 100% identical to SEQ ID NO: 92.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 3, wherein the engineered guide nucleic acid comprises: (i) a crRNA comprising a nucleobase sequence that is at least 75%, at least 80%, at least 85%, at least 90%, at least 95%, or 100% identical to SEQ ID NO: 48 and (ii) a tracrRNA comprising a nucleobase sequence that is at least 75%, at least 80%, at least 85%, at least 90%, at least 95%, or 100% identical to SEQ ID NO: 93.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 4, wherein the engineered guide nucleic acid comprises: (i) a crRNA comprising a nucleobase sequence that is at least 75%, at least 80%, at least 85%, at least 90%, at least 95%, or 100% identical to SEQ ID NO: 49 and (ii) a tracrRNA comprising a nucleobase sequence that is at least 75%, at least 80%, at least 85%, at least 90%, at least 95%, or 100% identical to SEQ ID NO: 94.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99%, or 100% identical to SEQ ID NO: 5, wherein the engineered guide nucleic acid comprises: (i) a crRNA comprising a nucleobase sequence that is at least 75%, at least 80%, at least 85%, at least 90%, at least 95%, or 100% identical to SEQ ID NO: 50 and (ii) a tracrRNA comprising a nucleobase sequence that is at least 75%, at least 80%, at least 85%, at least 90%, at least 95%, or 100% identical to SEQ ID NO: 95.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 6, wherein the engineered guide nucleic acid comprises: (i) a crRNA comprising a nucleobase sequence that is at least 75%, at least 80%, at least 85%, at least 90%, at least 95%, or 100% identical to SEQ ID NO: 51 and (ii) a tracrRNA comprising a nucleobase sequence that is at least 75%, at least 80%, at least 85%, at least 90%, at least 95%, or 100% identical to SEQ ID NO: 96.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 7, wherein the engineered guide nucleic acid comprises: (i) a crRNA comprising a nucleobase sequence that is at least 75%, at least 80%, at least 85%, at least 90%, at least 95%, or 100% identical to SEQ ID NO: 52 and (ii) a tracrRNA comprising a nucleobase sequence that is at least 75%, at least 80%, at least 85%, at least 90%, at least 95%, or 100% identical to SEQ ID NO: 97.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 8, wherein the engineered guide nucleic acid comprises: (i) a crRNA comprising a nucleobase sequence that is at least 75%, at least 80%, at least 85%, at least 90%, at least 95%, or 100% identical to SEQ ID NO: 53 and (ii) a tracrRNA comprising a nucleobase sequence that is at least 75%, at least 80%, at least 85%, at least 90%, at least 95%, or 100% identical to SEQ ID NO: 98.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 9, wherein the engineered guide nucleic acid comprises: (i) a crRNA comprising a nucleobase sequence that is at least 75%, at least 80%, at least 85%, at least 90%, at least 95%, or 100% identical to SEQ ID NO: 54 and (ii) a tracrRNA comprising a nucleobase sequence that is at least 75%, at least 80%, at least 85%, at least 90%, at least 95%, or 100% identical to SEQ ID NO: 99.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 10, wherein the engineered guide nucleic acid comprises: (i) a crRNA comprising a nucleobase sequence that is at least 75%, at least 80%, at least 85%, at least 90%, at least 95%, or 100% identical to SEQ ID NO: 55 and (ii) a tracrRNA comprising a nucleobase sequence that is at least 75%, at least 80%, at least 85%, at least 90%, at least 95%, or 100% identical to SEQ ID NO: 100.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 11, wherein the engineered guide nucleic acid comprises: (i) a crRNA comprising a nucleobase sequence that is at least 75%, at least 80%, at least 85%, at least 90%, at least 95%, or 100% identical to SEQ ID NO: 56 and (ii) a tracrRNA comprising a nucleobase sequence that is at least 75%, at least 80%, at least 85%, at least 90%, at least 95%, or 100% identical to SEQ ID NO: 101.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 12, wherein the engineered guide nucleic acid comprises: (i) a crRNA comprising a nucleobase sequence that is at least 75%, at least 80%, at least 85%, at least 90%, at least 95%, or 100% identical to SEQ ID NO: 57 and (ii) a tracrRNA comprising a nucleobase sequence that is at least 75%, at least 80%, at least 85%, at least 90%, at least 95%, or 100% identical to SEQ ID NO: 102.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 13, wherein the engineered guide nucleic acid comprises: (i) a crRNA comprising a nucleobase sequence that is at least 75%, at least 80%, at least 85%, at least 90%, at least 95%, or 100% identical to SEQ ID NO: 58 and (ii) a tracrRNA comprising a nucleobase sequence that is at least 75%, at least 80%, at least 85%, at least 90%, at least 95%, or 100% identical to SEQ ID NO: 103.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 14, wherein the engineered guide nucleic acid comprises: (i) a crRNA comprising a nucleobase sequence that is at least 75%, at least 80%, at least 85%, at least 90%, at least 95%, or 100% identical to SEQ ID NO: 59 and (ii) a tracrRNA comprising a nucleobase sequence that is at least 75%, at least 80%, at least 85%, at least 90%, at least 95%, or 100% identical to SEQ ID NO: 104.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 14, wherein the engineered guide nucleic acid comprises: (i) a crRNA comprising a nucleobase sequence that is at least 75%, at least 80%, at least 85%, at least 90%, at least 95%, or 100% identical to SEQ ID NO: 59 and (ii) a tracrRNA comprising a nucleobase sequence that is at least 75%, at least 80%, at least 85%, at least 90%, at least 95%, or 100% identical to SEQ ID NO: 105.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 15, wherein the engineered guide nucleic acid comprises: (i) a crRNA comprising a nucleobase sequence that is at least 75%, at least 80%, at least 85%, at least 90%, at least 95%, or 100% identical to SEQ ID NO: 60 and (ii) a tracrRNA comprising a nucleobase sequence that is at least 75%, at least 80%, at least 85%, at least 90%, at least 95%, or 100% identical to SEQ ID NO: 106.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 15, wherein the engineered guide nucleic acid comprises: (i) a crRNA comprising a nucleobase sequence that is at least 75%, at least 80%, at least 85%, at least 90%, at least 95%, or 100% identical to SEQ ID NO: 60 and (ii) a tracrRNA comprising a nucleobase sequence that is at least 75%, at least 80%, at least 85%, at least 90%, at least 95%, or 100% identical to SEQ ID NO: 107.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 16, wherein the engineered guide nucleic acid comprises: (i) a crRNA comprising a nucleobase sequence that is at least 75%, at least 80%, at least 85%, at least 90%, at least 95%, or 100% identical to SEQ ID NO: 61 and (ii) a tracrRNA comprising a nucleobase sequence that is at least 75%, at least 80%, at least 85%, at least 90%, at least 95%, or 100% identical to SEQ ID NO: 108.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 16, wherein the engineered guide nucleic acid comprises: (i) a crRNA comprising a nucleobase sequence that is at least 75%, at least 80%, at least 85%, at least 90%, at least 95%, or 100% identical to SEQ ID NO: 61 and (ii) a tracrRNA comprising a nucleobase sequence that is at least 75%, at least 80%, at least 85%, at least 90%, at least 95%, or 100% identical to SEQ ID NO: 109.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 17, wherein the engineered guide nucleic acid comprises: (i) a crRNA comprising a nucleobase sequence that is at least 75%, at least 80%, at least 85%, at least 90%, at least 95%, or 100% identical to SEQ ID NO: 62 and (ii) a tracrRNA comprising a nucleobase sequence that is at least 75%, at least 80%, at least 85%, at least 90%, at least 95%, or 100% identical to SEQ ID NO: 110.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 17, wherein the engineered guide nucleic acid comprises: (i) a crRNA comprising a nucleobase sequence that is at least 75%, at least 80%, at least 85%, at least 90%, at least 95%, or 100% identical to SEQ ID NO: 62 and (ii) a tracrRNA comprising a nucleobase sequence that is at least 75%, at least 80%, at least 85%, at least 90%, at least 95%, or 100% identical to SEQ ID NO: 111.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 18, wherein the engineered guide nucleic acid comprises: (i) a crRNA comprising a nucleobase sequence that is at least 75%, at least 80%, at least 85%, at least 90%, at least 95%, or 100% identical to SEQ ID NO: 63 and (ii) a tracrRNA comprising a nucleobase sequence that is at least 75%, at least 80%, at least 85%, at least 90%, at least 95%, or 100% identical to SEQ ID NO: 112.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 18, wherein the engineered guide nucleic acid comprises: (i) a crRNA comprising a nucleobase sequence that is at least 75%, at least 80%, at least 85%, at least 90%, at least 95%, or 100% identical to SEQ ID NO: 63 and (ii) a tracrRNA comprising a nucleobase sequence that is at least 75%, at least 80%, at least 85%, at least 90%, at least 95%, or 100% identical to SEQ ID NO: 113.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 19, wherein the engineered guide nucleic acid comprises: (i) a crRNA comprising a nucleobase sequence that is at least 75%, at least 80%, at least 85%, at least 90%, at least 95%, or 100% identical to SEQ ID NO: 64 and (ii) a tracrRNA comprising a nucleobase sequence that is at least 75%, at least 80%, at least 85%, at least 90%, at least 95%, or 100% identical to SEQ ID NO: 114.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 19, wherein the engineered guide nucleic acid comprises: (i) a crRNA comprising a nucleobase sequence that is at least 75%, at least 80%, at least 85%, at least 90%, at least 95%, or 100% identical to SEQ ID NO: 64 and (ii) a tracrRNA comprising a nucleobase sequence that is at least 75%, at least 80%, at least 85%, at least 90%, at least 95%, or 100% identical to SEQ ID NO: 115.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 20, wherein the engineered guide nucleic acid comprises: (i) a crRNA comprising a nucleobase sequence that is at least 75%, at least 80%, at least 85%, at least 90%, at least 95%, or 100% identical to SEQ ID NO: 65 and (ii) a tracrRNA comprising a nucleobase sequence that is at least 75%, at least 80%, at least 85%, at least 90%, at least 95%, or 100% identical to SEQ ID NO: 116.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 20, wherein the engineered guide nucleic acid comprises: (i) a crRNA comprising a nucleobase sequence that is at least 75%, at least 80%, at least 85%, at least 90%, at least 95%, or 100% identical to SEQ ID NO: 65 and (ii) a tracrRNA comprising a nucleobase sequence that is at least 75%, at least 80%, at least 85%, at least 90%, at least 95%, or 100% identical to SEQ ID NO: 117.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 21, wherein the engineered guide nucleic acid comprises: (i) a crRNA comprising a nucleobase sequence that is at least 75%, at least 80%, at least 85%, at least 90%, at least 95%, or 100% identical to SEQ ID NO: 66 and (ii) a tracrRNA comprising a nucleobase sequence that is at least 75%, at least 80%, at least 85%, at least 90%, at least 95%, or 100% identical to SEQ ID NO: 118.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 21, wherein the engineered guide nucleic acid comprises: (i) a crRNA comprising a nucleobase sequence that is at least 75%, at least 80%, at least 85%, at least 90%, at least 95%, or 100% identical to SEQ ID NO: 66 and (ii) a tracrRNA comprising a nucleobase sequence that is at least 75%, at least 80%, at least 85%, at least 90%, at least 95%, or 100% identical to SEQ ID NO: 119.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 22, wherein the engineered guide nucleic acid comprises: (i) a crRNA comprising a nucleobase sequence that is at least 75%, at least 80%, at least 85%, at least 90%, at least 95%, or 100% identical to SEQ ID NO: 67 and (ii) a tracrRNA comprising a nucleobase sequence that is at least 75%, at least 80%, at least 85%, at least 90%, at least 95%, or 100% identical to SEQ ID NO: 120.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23, wherein the engineered guide nucleic acid comprises: (i) a crRNA comprising a nucleobase sequence that is at least 75%, at least 80%, at least 85%, at least 90%, at least 95%, at least 98%, at least 99% or 100% identical to SEQ ID NO: 68 and (ii) a tracrRNA comprising a nucleobase sequence that is at least 75%, at least 80%, at least 85%, at least 90%, at least 95%, or 100% identical to SEQ ID NO: 120.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 24, wherein the engineered guide nucleic acid comprises: (i) a crRNA comprising a nucleobase sequence that is at least 75%, at least 80%, at least 85%, at least 90%, at least 95%, or 100% identical to SEQ ID NO: 69 and (ii) a tracrRNA comprising a nucleobase sequence that is at least 75%, at least 80%, at least 85%, at least 90%, at least 95%, or 100% identical to SEQ ID NO: 121.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 25, wherein the engineered guide nucleic acid comprises: (i) a crRNA comprising a nucleobase sequence that is at least 75%, at least 80%, at least 85%, at least 90%, at least 95%, or 100% identical to SEQ ID NO: 70 and (ii) a tracrRNA comprising a nucleobase sequence that is at least 75%, at least 80%, at least 85%, at least 90%, at least 95%, or 100% identical to SEQ ID NO: 122.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 26, wherein the engineered guide nucleic acid comprises: (i) a crRNA comprising a nucleobase sequence that is at least 75%, at least 80%, at least 85%, at least 90%, at least 95%, or 100% identical to SEQ ID NO: 71 and (ii) a tracrRNA comprising a nucleobase sequence that is at least 75%, at least 80%, at least 85%, at least 90%, at least 95%, or 100% identical to SEQ ID NO: 120.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 27, wherein the engineered guide nucleic acid comprises: (i) a crRNA comprising a nucleobase sequence that is at least 75%, at least 80%, at least 85%, at least 90%, at least 95%, or 100% identical to SEQ ID NO: 72 and (ii) a tracrRNA comprising a nucleobase sequence that is at least 75%, at least 80%, at least 85%, at least 90%, at least 95%, or 100% identical to SEQ ID NO: 123.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 28, wherein the engineered guide nucleic acid comprises: (i) a crRNA comprising a nucleobase sequence that is at least 75%, at least 80%, at least 85%, at least 90%, at least 95%, or 100% identical to SEQ ID NO: 73 and (ii) a tracrRNA comprising a nucleobase sequence that is at least 75%, at least 80%, at least 85%, at least 90%, at least 95%, or 100% identical to SEQ ID NO: 121.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 22, wherein the engineered guide nucleic acid comprises: (i) a crRNA comprising a nucleobase sequence that is at least 75%, at least 80%, at least 85%, at least 90%, at least 95%, or 100% identical to SEQ ID NO: 74 and (ii) a tracrRNA comprising a nucleobase sequence that is at least 75%, at least 80%, at least 85%, at least 90%, at least 95%, or 100% identical to SEQ ID NO: 121.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 30, wherein the engineered guide nucleic acid comprises: (i) a crRNA comprising a nucleobase sequence that is at least 75%, at least 80%, at least 85%, at least 90%, at least 95%, or 100% identical to SEQ ID NO: 75 and (ii) a tracrRNA comprising a nucleobase sequence that is at least 75%, at least 80%, at least 85%, at least 90%, at least 95%, or 100% identical to SEQ ID NO: 124.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 31, wherein the engineered guide nucleic acid comprises: (i) a crRNA comprising a nucleobase sequence that is at least 75%, at least 80%, at least 85%, at least 90%, at least 95%, or 100% identical to SEQ ID NO: 76 and (ii) a tracrRNA comprising a nucleobase sequence that is at least 75%, at least 80%, at least 85%, at least 90%, at least 95%, or 100% identical to SEQ ID NO: 122.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 32, wherein the engineered guide nucleic acid comprises: (i) a crRNA comprising a nucleobase sequence that is at least 75%, at least 80%, at least 85%, at least 90%, at least 95%, or 100% identical to SEQ ID NO: 77 and (ii) a tracrRNA comprising a nucleobase sequence that is at least 75%, at least 80%, at least 85%, at least 90%, at least 95%, or 100% identical to SEQ ID NO: 124.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 33, wherein the engineered guide nucleic acid comprises: (i) a crRNA comprising a nucleobase sequence that is at least 75%, at least 80%, at least 85%, at least 90%, at least 95%, or 100% identical to SEQ ID NO: 78 and (ii) a tracrRNA comprising a nucleobase sequence that is at least 75%, at least 80%, at least 85%, at least 90%, at least 95%, or 100% identical to SEQ ID NO: 125.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 33, wherein the engineered guide nucleic acid comprises: (i) a crRNA comprising a nucleobase sequence that is at least 75%, at least 80%, at least 85%, at least 90%, at least 95%, or 100% identical to SEQ ID NO: 78 and (ii) a tracrRNA comprising a nucleobase sequence that is at least 75%, at least 80%, at least 85%, at least 90%, at least 95%, or 100% identical to SEQ ID NO: 126.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 34, wherein the engineered guide nucleic acid comprises: (i) a crRNA comprising a nucleobase sequence that is at least 75%, at least 80%, at least 85%, at least 90%, at least 95%, or 100% identical to SEQ ID NO: 79 and (ii) a tracrRNA comprising a nucleobase sequence that is at least 75%, at least 80%, at least 85%, at least 90%, at least 95%, or 100% identical to SEQ ID NO: 127.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 35, wherein the engineered guide nucleic acid comprises: (i) a crRNA comprising a nucleobase sequence that is at least 75%, at least 80%, at least 85%, at least 90%, at least 95%, or 100% identical to SEQ ID NO: 80 and (ii) a tracrRNA comprising a nucleobase sequence that is at least 75%, at least 80%, at least 85%, at least 90%, at least 95%, or 100% identical to SEQ ID NO: 128.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 35, wherein the engineered guide nucleic acid comprises: (i) a crRNA comprising a nucleobase sequence that is at least 75%, at least 80%, at least 85%, at least 90%, at least 95%, or 100% identical to SEQ ID NO: 80 and (ii) a tracrRNA comprising a nucleobase sequence that is at least 75%, at least 80%, at least 85%, at least 90%, at least 95%, or 100% identical to SEQ ID NO: 129.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 36, wherein the engineered guide nucleic acid comprises: (i) a crRNA comprising a nucleobase sequence that is at least 75%, at least 80%, at least 85%, at least 90%, at least 95%, or 100% identical to SEQ ID NO: 81 and (ii) a tracrRNA comprising a nucleobase sequence that is at least 75%, at least 80%, at least 85%, at least 90%, at least 95%, or 100% identical to SEQ ID NO: 130.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 36, wherein the engineered guide nucleic acid comprises: (i) a crRNA comprising a nucleobase sequence that is at least 75%, at least 80%, at least 85%, at least 90%, at least 95%, or 100% identical to SEQ ID NO: 81 and (ii) a tracrRNA comprising a nucleobase sequence that is at least 75%, at least 80%, at least 85%, at least 90%, at least 95%, or 100% identical to SEQ ID NO: 131.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 37, wherein the engineered guide nucleic acid comprises: (i) a crRNA comprising a nucleobase sequence that is at least 75%, at least 80%, at least 85%, at least 90%, at least 95%, or 100% identical to SEQ ID NO: 82 and (ii) a tracrRNA comprising a nucleobase sequence that is at least 75%, at least 80%, at least 85%, at least 90%, at least 95%, or 100% identical to SEQ ID NO: 132.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 37, wherein the engineered guide nucleic acid comprises: (i) a crRNA comprising a nucleobase sequence that is at least 75%, at least 80%, at least 85%, at least 90%, at least 95%, or 100% identical to SEQ ID NO: 82 and (ii) a tracrRNA comprising a nucleobase sequence that is at least 75%, at least 80%, at least 85%, at least 90%, at least 95%, or 100% identical to SEQ ID NO: 133.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 38, wherein the engineered guide nucleic acid comprises: (i) a crRNA comprising a nucleobase sequence that is at least 75%, at least 80%, at least 85%, at least 90%, at least 95%, or 100% identical to SEQ ID NO: 83 and (ii) a tracrRNA comprising a nucleobase sequence that is at least 75%, at least 80%, at least 85%, at least 90%, at least 95%, or 100% identical to SEQ ID NO: 134.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 38, wherein the engineered guide nucleic acid comprises: (i) a crRNA comprising a nucleobase sequence that is at least 75%, at least 80%, at least 85%, at least 90%, at least 95%, or 100% identical to SEQ ID NO: 83 and (ii) a tracrRNA comprising a nucleobase sequence that is at least 75%, at least 80%, at least 85%, at least 90%, at least 95%, or 100% identical to SEQ ID NO: 135.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 39, wherein the engineered guide nucleic acid comprises: (i) a crRNA comprising a nucleobase sequence that is at least 75%, at least 80%, at least 85%, at least 90%, at least 95%, or 100% identical to SEQ ID NO: 84 and (ii) a tracrRNA comprising a nucleobase sequence that is at least 75%, at least 80%, at least 85%, at least 90%, at least 95%, or 100% identical to SEQ ID NO: 136.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 39, wherein the engineered guide nucleic acid comprises: (i) a crRNA comprising a nucleobase sequence that is at least 75%, at least 80%, at least 85%, at least 90%, at least 95%, or 100% identical to SEQ ID NO: 84 and (ii) a tracrRNA comprising a nucleobase sequence that is at least 75%, at least 80%, at least 85%, at least 90%, at least 95%, or 100% identical to SEQ ID NO: 137.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 40, wherein the engineered guide nucleic acid comprises: (i) a crRNA comprising a nucleobase sequence that is at least 75%, at least 80%, at least 85%, at least 90%, at least 95%, or 100% identical to SEQ ID NO: 85 and (ii) a tracrRNA comprising a nucleobase sequence that is at least 75%, at least 80%, at least 85%, at least 90%, at least 95%, or 100% identical to SEQ ID NO: 138.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 41, wherein the engineered guide nucleic acid comprises: (i) a crRNA comprising a nucleobase sequence that is at least 75%, at least 80%, at least 85%, at least 90%, at least 95%, or 100% identical to SEQ ID NO: 86 and (ii) a tracrRNA comprising a nucleobase sequence that is at least 75%, at least 80%, at least 85%, at least 90%, at least 95%, or 100% identical to SEQ ID NO: 139.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 41, wherein the engineered guide nucleic acid comprises: (i) a crRNA comprising a nucleobase sequence that is at least 75%, at least 80%, at least 85%, at least 90%, at least 95%, or 100% identical to SEQ ID NO: 86 and (ii) a tracrRNA comprising a nucleobase sequence that is at least 75%, at least 80%, at least 85%, at least 90%, at least 95%, or 100% identical to SEQ ID NO: 140.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 42, wherein the engineered guide nucleic acid comprises: (i) a crRNA comprising a nucleobase sequence that is at least 75%, at least 80%, at least 85%, at least 90%, at least 95%, or 100% identical to SEQ ID NO: 87 and (ii) a tracrRNA comprising a nucleobase sequence that is at least 75%, at least 80%, at least 85%, at least 90%, at least 95%, or 100% identical to SEQ ID NO: 141.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 42, wherein the engineered guide nucleic acid comprises: (i) a crRNA comprising a nucleobase sequence that is at least 75%, at least 80%, at least 85%, at least 90%, at least 95%, or 100% identical to SEQ ID NO: 87 and (ii) a tracrRNA comprising a nucleobase sequence that is at least 75%, at least 80%, at least 85%, at least 90%, at least 95%, or 100% identical to SEQ ID NO: 142.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 43, wherein the engineered guide nucleic acid comprises: (i) a crRNA comprising a nucleobase sequence that is at least 75%, at least 80%, at least 85%, at least 90%, at least 95%, or 100% identical to SEQ ID NO: 88 and (ii) a tracrRNA comprising a nucleobase sequence that is at least 75%, at least 80%, at least 85%, at least 90%, at least 95%, or 100% identical to SEQ ID NO: 143.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 43, wherein the engineered guide nucleic acid comprises: (i) a crRNA comprising a nucleobase sequence that is at least 75%, at least 80%, at least 85%, at least 90%, at least 95%, or 100% identical to SEQ ID NO: 88 and (ii) a tracrRNA comprising a nucleobase sequence that is at least 75%, at least 80%, at least 85%, at least 90%, at least 95%, or 100% identical to SEQ ID NO: 144.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 44, wherein the engineered guide nucleic acid comprises: (i) a crRNA comprising a nucleobase sequence that is at least 75%, at least 80%, at least 85%, at least 90%, at least 95%, or 100% identical to SEQ ID NO: 89 and (ii) a tracrRNA comprising a nucleobase sequence that is at least 75%, at least 80%, at least 85%, at least 90%, at least 95%, or 100% identical to SEQ ID NO: 145.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 44, wherein the engineered guide nucleic acid comprises: (i) a crRNA comprising a nucleobase sequence that is at least 75%, at least 80%, at least 85%, at least 90%, at least 95%, or 100% identical to SEQ ID NO: 89 and (ii) a tracrRNA comprising a nucleobase sequence that is at least 75%, at least 80%, at least 85%, at least 90%, at least 95%, or 100% identical to SEQ ID NO: 146.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 45, wherein the engineered guide nucleic acid comprises: (i) a crRNA comprising a nucleobase sequence that is at least 75%, at least 80%, at least 85%, at least 90%, at least 95%, or 100% identical to SEQ ID NO: 90 and (ii) a tracrRNA comprising a nucleobase sequence that is at least 75%, at least 80%, at least 85%, at least 90%, at least 95%, or 100% identical to SEQ ID NO: 147.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 45, wherein the engineered guide nucleic acid comprises: (i) a crRNA comprising a nucleobase sequence that is at least 75%, at least 80%, at least 85%, at least 90%, at least 95%, or 100% identical to SEQ ID NO: 90 and (ii) a tracrRNA comprising a nucleobase sequence that is at least 75%, at least 80%, at least 85%, at least 90%, at least 95%, or 100% identical to SEQ ID NO: 148.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 22, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 149.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 149.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 24, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 150.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 25, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 151.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 26, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 149.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 28, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 150.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 29, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 150.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 30, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 152.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 31, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 151.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 32, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 152.

Also provided herein, are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 33, wherein the engineered guide nucleic acid comprises: a single guide RNA comprising a nucleobase sequence that is at least 75%, at least 80%, at least 85%, at least 90%, at least 95%, at least 98%, at least 99% or 100% identical to SEQ ID NO: 153.

Also provided herein, are any one of the compositions disclosed herein, wherein the crRNA and the tracrRNA are linked in a single guide RNA.

Also provided herein, are any one of the compositions disclosed herein, wherein the effector protein comprises a nuclear localization signal.

Also provided herein, are a pharmaceutical composition, comprising any one of the compositions disclosed herein and a pharmaceutically acceptable excipient.

Also provided herein, are systems comprising any one of the compositions disclosed herein. In some embodiments, the system comprises at least one detection reagent for detecting a target nucleic acid. In some embodiments, the at least one detection reagent is selected from a reporter nucleic acid, a detection moiety, an additional effector protein, or a combination thereof, optionally wherein the reporter nucleic acid comprises a fluorophore, a quencher, or a combination thereof. In some embodiments, the system further comprises at least one amplification reagent for amplifying a target nucleic acid. In some embodiments, at least one amplification reagent is selected from the group consisting of a primer, a polymerase, an activator, a dNTP, an rNTP, and combinations thereof. In some embodiments, the target nucleic acid comprises a PAM sequence selected from any one of SEQ ID NOs: 256-270. In some embodiments, the target nucleic acid comprises a PAM sequence selected from any one of SEQ ID NOs: 301-371.

Also provided herein are methods of detecting a target nucleic acid in a sample, comprising contacting the sample with any one of the compositions disclosed herein or any one of the systems disclosed herein, thereby generating a modification of the target nucleic acid; and detecting the modification. In some embodiments, the methods can comprise the steps of: (a) contacting the sample with: (i) any one of the compositions disclosed herein or any one of the systems disclosed herein; and (ii) a reporter nucleic acid comprising a detectable moiety that produces a detectable signal in the presence of the target nucleic acid and the composition or system, and (b) detecting the detectable signal. In some embodiments, the target nucleic acid comprises a PAM sequence selected from any one of SEQ ID NOs: 256-270. In some embodiments, the target nucleic acid comprises a PAM sequence selected from any one of SEQ ID NOs: 301-371.

In some embodiments, (i) the effector protein comprises an amino acid sequence that is at least 75%, at least 80%, at least 85%, at least 90%, at least 95%, at least 98%, at least 99% or 100% identical to SEQ ID NO: 1; (ii) the crRNA comprises a nucleobase sequence that is at least 75%, at least 80%, at least 85%, at least 90%, at least 95%, or 100% identical to SEQ ID NO: 46; (iii) the tracrRNA comprises a nucleobase sequence that is at least 75%, at least 80%, at least 85%, at least 90%, at least 95%, or 100% identical to SEQ ID NO: 91. In some instances, the target nucleic acid has a PAM sequence of CTT (SEQ ID NO: 154).

In some embodiments, the effector protein comprises an amino acid sequence that is at least 75%, at least 80%, at least 85%, at least 90%, at least 95%, at least 98%, at least 99% or 100% identical to SEQ ID NO: 13; (i) the crRNA comprises a nucleobase sequence that is at least 75%, at least 80%, at least 85%, at least 90%, at least 95%, or 100% identical to SEQ ID NO: 58; (ii) the tracrRNA comprises a nucleobase sequence that is at least 75%, at least 80%, at least 85%, at least 90%, at least 95%, or 100% identical to SEQ ID NO: 103; and (iii) the target nucleic acid has a PAM sequence of CTT (SEQ ID NO: 154).

In some embodiments, (i) the effector protein comprises an amino acid sequence that is at least 75%, at least 80%, at least 85%, at least 90%, at least 95%, at least 98%, at least 99% or 100% identical to SEQ ID NO: 15; (ii) the crRNA comprises a nucleobase sequence that is at least 75%, at least 80%, at least 85%, at least 90%, at least 95%, or 100% identical to SEQ ID NO: 60; (iii) the tracrRNA comprises a nucleobase sequence that is at least 75%, at least 80%, at least 85%, at least 90%, at least 95%, or 100% identical to SEQ ID NO: 106; and (iv) the target nucleic acid has a PAM sequence of CC (SEQ ID NO: 155). In some embodiments, (i) the effector protein comprises an amino acid sequence that is at least 75%, at least 80%, at least 85%, at least 90%, at least 95%, at least 98%, at least 99% or 100% identical to SEQ ID NO: 15; (ii) the crRNA comprises a nucleobase sequence that is at least 75%, at least 80%, at least 85%, at least 90%, at least 95%, or 100% identical to SEQ ID NO: 60; (iii) the tracrRNA comprises a nucleobase sequence that is at least 75%, at least 80%, at least 85%, at least 90%, at least 95%, or 100% identical to SEQ ID NO: 107; and (iv) the target nucleic acid has a PAM sequence of CC (SEQ ID NO: 155).

In some embodiments, (i) the effector protein comprises an amino acid sequence that is at least 75%, at least 80%, at least 85%, at least 90%, at least 95%, at least 98%, at least 99% or 100% identical to SEQ ID NO: 22; (ii) the crRNA comprises a nucleobase sequence that is at least 75%, at least 80%, at least 85%, at least 90%, at least 95%, or 100% identical to SEQ ID NO: 67; (iii) the tracrRNA comprises a nucleobase sequence that is at least 75%, at least 80%, at least 85%, at least 90%, at least 95%, or 100% identical to SEQ ID NO: 120; and (iv) the target nucleic acid has a PAM sequence of GCG (SEQ ID NO: 157). In some embodiments, (i) the effector protein comprises an amino acid sequence that is at least 75%, at least 80%, at least 85%, at least 90%, at least 95%, at least 98%, at least 99% or 100% identical to SEQ ID NO: 22; (ii) the sgRNA comprises a nucleobase sequence that is at least 75%, at least 80%, at least 85%, at least 90%, at least 95%, at least 98%, at least 99% or 100% identical to SEQ ID NO: 149; and (iii) the target nucleic acid has a PAM sequence of TCG (SEQ ID NO: 156).

In some embodiments (i) the effector protein comprises an amino acid sequence that is at least 75%, at least 80%, at least 85%, at least 90%, at least 95%, at least 98%, at least 99% or 100% identical to SEQ ID NO: 23; (ii) the crRNA comprises a nucleobase sequence that is at least 75%, at least 80%, at least 85%, at least 90%, at least 95%, or 100% identical to SEQ ID NO: 68; (iii) the tracrRNA comprises a nucleobase sequence that is at least 75%, at least 80%, at least 85%, at least 90%, at least 95%, or 100% identical to SEQ ID NO: 120; and (iv) the target nucleic acid has a PAM sequence of TCG (SEQ ID NO: 156), TTG (SEQ ID NO: 158), GCG (SEQ ID NO: 157), or GTG (SEQ ID NO: 159). In some embodiments, (i) the effector protein comprises an amino acid sequence that is at least 75%, at least 80%, at least 85%, at least 90%, at least 95%, at least 98%, at least 99% or 100% identical to SEQ ID NO: 23; (ii) the sgRNA comprises a nucleobase sequence that is at least 75%, at least 80%, at least 85%, at least 90%, at least 95%, at least 98%, at least 99% or 100% identical to SEQ ID NO: 149; and (iii) the target nucleic acid has a PAM sequence of TCG (SEQ ID NO: 156), TTG (SEQ ID NO: 158), GCG (SEQ ID NO: 157) or GTG (SEQ ID NO: 159).

In some embodiments, (i) the effector protein comprises an amino acid sequence that is at least 75%, at least 80%, at least 85%, at least 90%, at least 95%, at least 98%, at least 99% or 100% identical to SEQ ID NO: 24; (ii) the crRNA comprises a nucleobase sequence that is at least 75%, at least 80%, at least 85%, at least 90%, at least 95%, or 100% identical to SEQ ID NO: 69; (iii) the tracrRNA comprises a nucleobase sequence that is at least 75%, at least 80%, at least 85%, at least 90%, at least 95%, or 100% identical to SEQ ID NO: 121; and (iv) the target nucleic acid has a PAM sequence of TCG (SEQ ID NO: 156). In some examples, (i) the effector protein comprises an amino acid sequence that is at least 75%, at least 80%, at least 85%, at least 90%, at least 95%, at least 98%, at least 99% or 100% identical to SEQ ID NO: 24; (ii) the sgRNA comprises a nucleobase sequence that is at least 75%, at least 80%, at least 85%, at least 90%, at least 95%, at least 98%, at least 99% or 100% identical to SEQ ID NO: 150; and (iii) the target nucleic acid has a PAM sequence of TCG (SEQ ID NO: 156).

In some embodiments, (i) the effector protein comprises an amino acid sequence that is at least 75%, at least 80%, at least 85%, at least 90%, at least 95%, at least 98%, at least 99% or 100% identical to SEQ ID NO: 25; (ii) the crRNA comprises a nucleobase sequence that is at least 75%, at least 80%, at least 85%, at least 90%, at least 95%, or 100% identical to SEQ ID NO: 70; (iii) the tracrRNA comprises a nucleobase sequence that is at least 75%, at least 80%, at least 85%, at least 90%, at least 95%, or 100% identical to SEQ ID NO: 122; and (iv) the target nucleic acid has a PAM sequence of ATTA (SEQ ID NO: 160), ATTG (SEQ ID NO: 161), GTTA (SEQ ID NO: 162), or GTTG (SEQ ID NO: 163). In some embodiments, (i) the effector protein comprises an amino acid sequence that is at least 75%, at least 80%, at least 85%, at least 90%, at least 95%, at least 98%, at least 99% or 100% identical to SEQ ID NO: 25; (ii) the sgRNA comprises a nucleobase sequence that is at least 75%, at least 80%, at least 85%, at least 90%, at least 95%, at least 98%, at least 99% or 100% identical to SEQ ID NO: 151; and (iii) the target nucleic acid has a PAM sequence of ATTA (SEQ ID NO: 160), ATTG (SEQ ID NO: 161), GTTA (SEQ ID NO: 162), or GTTG (SEQ ID NO: 163).

In some embodiments, (i) the effector protein comprises an amino acid sequence that is at least 75%, at least 80%, at least 85%, at least 90%, at least 95%, at least 98%, at least 99% or 100% identical to SEQ ID NO: 26; (ii) the sgRNA comprises a nucleobase sequence that is at least 75%, at least 80%, at least 85%, at least 90%, at least 95%, at least 98%, at least 99% or 100% identical to SEQ ID NO: 149; and (iii) the target nucleic acid has PAM sequence of TCG (SEQ ID NO: 156).

In some embodiments, (i) the effector protein comprises an amino acid sequence that is at least 75%, at least 80%, at least 85%, at least 90%, at least 95%, at least 98%, at least 99% or 100% identical to SEQ ID NO: 28; (ii) the crRNA comprises a nucleobase sequence that is at least 75%, at least 80%, at least 85%, at least 90%, at least 95%, or 100% identical to SEQ ID NO: 73; (iii) the tracrRNA comprises a nucleobase sequence that is at least 75%, at least 80%, at least 85%, at least 90%, at least 95%, or 100% identical to SEQ ID NO: 121; and (iv) the target nucleic acid has a PAM sequence of ATTA (SEQ ID NO: 160), ATTG (SEQ ID NO: 161), GTTA (SEQ ID NO: 162), or GTTG (SEQ ID NO: 163). In some embodiments, (i) the effector protein comprises an amino acid sequence that is at least 75%, at least 80%, at least 85%, at least 90%, at least 95%, at least 98%, at least 99% or 100% identical to SEQ ID NO: 28; (ii) the sgRNA comprises a nucleobase sequence that is at least 75%, at least 80%, at least 85%, at least 90%, at least 95%, at least 98%, at least 99% or 100% identical to SEQ ID NO: 150; and (iii) the target nucleic acid has a PAM sequence of ATTA (SEQ ID NO: 160), ATTG (SEQ ID NO: 161), GTTA (SEQ ID NO: 162), or GTTG (SEQ ID NO: 163).

In some embodiments, (i) the effector protein comprises an amino acid sequence that is at least 75%, at least 80%, at least 85%, at least 90%, at least 95%, at least 98%, at least 99% or 100% identical to SEQ ID NO: 31; (ii) the sgRNA comprises a nucleobase sequence that is at least 75%, at least 80%, at least 85%, at least 90%, at least 95%, at least 98%, at least 99% or 100% identical to SEQ ID NO: 151; and (iii) the target nucleic acid has a PAM sequence of ATTA (SEQ ID NO: 160), ATTG (SEQ ID NO: 161), GTTA (SEQ ID NO: 162), or GTTG (SEQ ID NO: 163).

In some embodiments, (i) the effector protein comprises an amino acid sequence that is at least 75%, at least 80%, at least 85%, at least 90%, at least 95%, at least 98%, at least 99% or 100% identical to SEQ ID NO: 32; (ii) the sgRNA comprises a nucleobase sequence that is at least 75%, at least 80%, at least 85%, at least 90%, at least 95%, at least 98%, at least 99% or 100% identical to SEQ ID NO: 152; and (iii) the target nucleic acid has a PAM sequence of TCG (SEQ ID NO: 156) or GCG (SEQ ID NO: 157).

In some embodiments, (i) the effector protein comprises an amino acid sequence that is at least 75%, at least 80%, at least 85%, at least 90%, at least 95%, at least 98%, at least 99% or 100% identical to SEQ ID NO: 21; (ii) the crRNA comprises a nucleobase sequence that is at least 75%, at least 80%, at least 85%, at least 90%, at least 95%, or 100% identical to SEQ ID NO: 66; (iii) the tracrRNA comprises a nucleobase sequence that is at least 75%, at least 80%, at least 85%, at least 90%, at least 95%, or 100% identical to SEQ ID NO: 118; and (iv) the target nucleic acid has a PAM sequence of TC (SEQ ID NO: 164).

In some embodiments, (i) the effector protein comprises an amino acid sequence that is at least 75%, at least 80%, at least 85%, at least 90%, at least 95%, at least 98%, at least 99% or 100% identical to SEQ ID NO: 29; (ii) the crRNA comprises a nucleobase sequence that is at least 75%, at least 80%, at least 85%, at least 90%, at least 95%, or 100% identical to SEQ ID NO: 74; (iii) the tracrRNA comprises a nucleobase sequence that is at least 75%, at least 80%, at least 85%, at least 90%, at least 95%, or 100% identical to SEQ ID NO: 121; and (iv) the target nucleic acid has a PAM sequence of ATTG (SEQ ID NO: 161), ACTG (SEQ ID NO: 165), GTTG (SEQ ID NO: 163), or GCTG (SEQ ID NO: 166).

In some embodiments, (i) the effector protein comprises an amino acid sequence that is at least 75%, at least 80%, at least 85%, at least 90%, at least 95%, at least 98%, at least 99% or 100% identical to SEQ ID NO: 30; (ii) the crRNA comprises a nucleobase sequence that is at least 75%, at least 80%, at least 85%, at least 90%, at least 95%, or 100% identical to SEQ ID NO: 75; (iii) the tracrRNA comprises a nucleobase sequence that is at least 75%, at least 80%, at least 85%, at least 90%, at least 95%, or 100% identical to SEQ ID NO: 124; and (iv) the target nucleic acid has a PAM sequence of TCG (SEQ ID NO: 156).

In some embodiments, (i) the effector protein comprises an amino acid sequence that is at least 75%, at least 80%, at least 85%, at least 90%, at least 95%, at least 98%, at least 99% or 100% identical to SEQ ID NO: 34; (ii) the crRNA comprises a nucleobase sequence that is at least 75%, at least 80%, at least 85%, at least 90%, at least 95%, or 100% identical to SEQ ID NO: 79; (iii) the tracrRNA comprises a nucleobase sequence that is at least 75%, at least 80%, at least 85%, at least 90%, at least 95%, or 100% identical to SEQ ID NO: 127; and (iv) the target nucleic acid has a PAM sequence of ATTA (SEQ ID NO: 160), ATTG (SEQ ID NO: 161), GTTA (SEQ ID NO: 162), or GTTG (SEQ ID NO: 163).

In some embodiments, (i) the effector protein comprises an amino acid sequence that is at least 75%, at least 80%, at least 85%, at least 90%, at least 95%, at least 98%, at least 99% or 100% identical to SEQ ID NO: 44; (ii) the crRNA comprises a nucleobase sequence that is at least 75%, at least 80%, at least 85%, at least 90%, at least 95%, or 100% identical to SEQ ID NO: 89; (iii) the tracrRNA comprises a nucleobase sequence that is at least 75%, at least 80%, at least 85%, at least 90%, at least 95%, or 100% identical to SEQ ID NO: 145; and (iv) the target nucleic acid has a PAM sequence of TTC (SEQ ID NO: 167).

In some embodiments, (i) the effector protein comprises an amino acid sequence that is at least 75%, at least 80%, at least 85%, at least 90%, at least 95%, at least 98%, at least 99% or 100% identical to SEQ ID NO: 45; (ii) the crRNA comprises a nucleobase sequence that is at least 75%, at least 80%, at least 85%, at least 90%, at least 95%, or 100% identical to SEQ ID NO: 90; (iii) the tracrRNA comprises a nucleobase sequence that is at least 75%, at least 80%, at least 85%, at least 90%, at least 95%, or 100% identical to SEQ ID NO: 147; and (iv) the target nucleic acid has a PAM sequence of TTT (SEQ ID NO: 168), or TTC (SEQ ID NO: 167). In some embodiments, (i) the effector protein comprises an amino acid sequence that is at least 75%, at least 80%, at least 85%, at least 90%, at least 95%, at least 98%, at least 99% or 100% identical to SEQ ID NO: 45; (ii) the crRNA comprises a nucleobase sequence that is at least 75%, at least 80%, at least 85%, at least 90%, at least 95%, or 100% identical to SEQ ID NO: 90; (iii) the tracrRNA comprises a nucleobase sequence that is at least 75%, at least 80%, at least 85%, at least 90%, at least 95%, or 100% identical to SEQ ID NO: 148; and (iv) the target nucleic acid has a PAM sequence of TTT (SEQ ID NO: 168), or TTC (SEQ ID NO: 167).

In some embodiments, (i) the effector protein comprises an amino acid sequence that is at least 75%, at least 80%, at least 85%, at least 90%, at least 95%, at least 98%, at least 99% or 100% identical to SEQ ID NO: 18; (ii) the crRNA comprises a nucleobase sequence that is at least 75%, at least 80%, at least 85%, at least 90%, at least 95%, or 100% identical to SEQ ID NO: 63; (iii) the tracrRNA comprises a nucleobase sequence that is at least 75%, at least 80%, at least 85%, at least 90%, at least 95%, or 100% identical to SEQ ID NO: 113; and (iv) the target nucleic acid has a PAM sequence of CC (SEQ ID NO: 155).

In some embodiments, (i) the effector protein comprises an amino acid sequence that is at least 75%, at least 80%, at least 85%, at least 90%, at least 95%, at least 98%, at least 99% or 100% identical to SEQ ID NO: 19; (ii) the crRNA comprises a nucleobase sequence that is at least 75%, at least 80%, at least 85%, at least 90%, at least 95%, or 100% identical to SEQ ID NO: 64; (iii) the tracrRNA comprises a nucleobase sequence that is at least 75%, at least 80%, at least 85%, at least 90%, at least 95%, or 100% identical to SEQ ID NO: 114; and (iv) the target nucleic acid has a PAM sequence of CC (SEQ ID NO: 155).

In some embodiments, (i) the effector protein comprises an amino acid sequence that is at least 75%, at least 80%, at least 85%, at least 90%, at least 95%, at least 98%, at least 99% or 100% identical to SEQ ID NO: 43; (ii) the crRNA comprises a nucleobase sequence that is at least 75%, at least 80%, at least 85%, at least 90%, at least 95%, or 100% identical to SEQ ID NO: 88; (iii) the tracrRNA comprises a nucleobase sequence that is at least 75%, at least 80%, at least 85%, at least 90%, at least 95%, or 100% identical to SEQ ID NO: 144; and (iv) the target nucleic acid has a PAM sequence of TTC (SEQ ID NO: 167).

In some embodiments, the reporter nucleic acid comprises a fluorophore, a quencher, or a combination thereof, and wherein the detecting comprises detecting a fluorescent signal. In some embodiments, the method further comprises reverse transcribing the target nucleic acid, amplifying the target nucleic acid, in vitro transcribing the target nucleic acid, or any combination thereof. In some embodiments, the method further comprises reverse transcribing the target nucleic acid and/or amplifying the target nucleic acid before contacting the sample with the composition. In some embodiments, the method further comprises reverse transcribing the target nucleic acid and/or amplifying the target nucleic acid after contacting the sample with the composition. In some embodiments, the amplifying comprises isothermal amplification. In some examples, the target nucleic acid is from a pathogen. In some examples, the pathogen is a virus. In some embodiments, the virus is a SARS-CoV-2 virus or a variant thereof, an influenza A virus, an influenza B virus, a human papillomavirus, a herpes simplex virus, or a combination thereof. In some embodiments, the pathogen is a bacterium. In some embodiments, the bacterium is *Chlamydia trachomatis*. In some embodiments, the target nucleic acid is an RNA. In some embodiments, the target nucleic acid is DNA.

Also provided herein is a method of modifying a target nucleic acid, the method comprising contacting the target nucleic acid with any one of the compositions provided herein, thereby modifying the target nucleic acid. In some embodiments, modifying the target nucleic acid comprises cleaving the target nucleic acid, deleting a nucleotide of the target nucleic acid, inserting a nucleotide into the target nucleic acid, substituting a nucleotide of the target nucleic acid with a donor nucleotide or an additional nucleotide, or any combination thereof. In some embodiments, the method further comprises contacting the target nucleic acid with a donor nucleic acid. In some embodiments, the target nucleic acid comprises a mutation associated with a disease. In some embodiments, the disease is suspected to cause, at least in part, a cancer, an inherited disorder, an ophthalmological disorder, or a combination thereof. In some embodiments, the disease is cancer, an ophthalmological disease, a neurological disorder, a blood disorder, or a metabolic disorder. In some embodiments, the neurological disorder is Duchenne muscular dystrophy, myotonic dystrophy Type 1, or cystic fibrosis. In some embodiments, the neurological disorder is a neurodegenerative disease. In some embodiments, the target nucleic acid is encoded by a gene selected from TABLE 4. In some embodiments, the gene is PCSK9. In some embodiments, the gene is B2M, TRAC, or CIITA, or NGCG_B2M, or a combination thereof. In some embodiments, the gene is IRAC, B2M, PD1, or a combination thereof. In some embodiments, the contacting occurs in vitro. In some embodiments, the contacting occurs in vivo. In some embodiments, the contacting occurs ex vivo.

Also provided herein is a method of modifying a target nucleic acid, the method comprising contacting any one of the systems disclosed herein with the target nucleic acid, thereby modifying the target nucleic acid. In some embodiments, modifying the target nucleic acid comprises cleaving the target nucleic acid, deleting a nucleotide of the target nucleic acid, inserting a nucleotide into the target nucleic acid, substituting a nucleotide of the target nucleic acid with a donor nucleotide or an additional nucleotide, or any combination thereof. In some embodiments, the method further comprises contacting the target nucleic acid with a donor nucleic acid. In some embodiments, the target nucleic acid comprises a mutation associated with a disease. In some embodiments, the disease is suspected to cause, at least in part, a cancer, an inherited disorder, an ophthalmological disorder, or a combination thereof. In some embodiments, the the disease is cancer, an ophthalmological disease, a neurological disorder, a blood disorder, or a metabolic disorder. In some embodiments, the neurological disorder is Duchenne muscular dystrophy, myotonic dystrophy Type 1, or cystic fibrosis. In some embodiments, the neurological disorder is a neurodegenerative disease. In some embodiments, the target nucleic acid is encoded by a gene selected from TABLE 4. In some embodiments, the gene is PCSK9. In some embodiments, the gene is IRAC, B2M, PD1, or a combination thereof. In some embodiments, the contacting occurs in vitro. In some embodiments, the contacting occurs in vivo. In some embodiments, the contacting occurs ex vivo.

Also provided herein is a cell comprising any one of the compositions provided herein. In some embodiments, the cell is a T cell. In some examples, the T cell is a natural killer T cell (NKT). In some embodiments, the cell is an induced pluripotent stem cell (iPSC).

Also provided herein is a cell produced by any one of the methods disclosed herein. In some embodiments, the cell is a T cell. In some examples, the T cell is a natural killer T cell (NKT). In some embodiments, the cell is an induced pluripotent stem cell (iPSC).

Also provided herein is a population of cells produced by any one of the methods disclosed herein. In some examples, the population of cells comprises T cells. In some examples, the population of cells comprises NKT cells. In some examples, the population of cells comprise iPSCs.

Also provided herein is a method of producing a protein, the method comprising, (i) contacting a cell comprising a target nucleic acid to the composition of any one of claims 1-126, thereby editing the target nucleic acid to produce a modified cell comprising a modified nucleic acid; and (ii) producing a protein from the cell that is encoded, transcriptionally affected, or translationally affected by the modified nucleic acid. In some embodiments, the method further comprises contacting the cell to a DNA donor template. In some embodiments, the cell is a cancer cell, an animal cell, an HEK293 cell, or an immune cell. In some embodiments, the cell is a Chinese hamster ovary cell. In some embodiments, the method further comprises treating a disease.

Also provided herein are methods of editing a target nucleic acid in a mammalian cell comprising contacting the mammalian cell with a composition comprising an effector protein and a guide nucleic acid, wherein the effector protein comprises an amino acid sequence that is at least 75%, at least 80%, at least 85%, at least 90%, at least 95%, at least 98%, at least 99% or 100% identical to SEQ ID NO: 23. In some embodiments, the guide nucleic acid comprises a sequence that is at least 75%, at least 80%, at least 85%, at least 90%, at least 95%, at least 98%, at least 99% or 100% identical to SEQ ID NO: 186. In some embodiments, the guide nucleic acid comprises at least about 40, at least about 50, at least about 60, or at least about 70 contiguous nucleotides that are at least 75%, at least 80%, at least 85%, at least 90%, at least 95%, at least 98%, at least 99% or 100% identical to SEQ ID NO: 186.

Also provided herein are mammalian cells or a population of mammalian cells produced by any of the methods described herein.

Also described herein are methods of editing a target nucleic acid in a mammalian cell comprising contacting the mammalian cell with a composition comprising a fusion protein, wherein the fusion protein comprises a fusion partner protein and an effector protein, wherein the effector protein comprises an amino acid sequence that is at least 75%, at least 80%, at least 85%, at least 90%, at least 95%, at least 98%, at least 99% or 100% identical to SEQ ID NO: 729. In some embodiments, the fusion partner protein comprises a base editing enzyme. In some embodiments, the base editing enzyme comprises a deaminase or an enzyme with deaminase activity. In some embodiments, the fusion partner protein is selected from the group consisting of: ABE8e, ABE8.20m, APOBEC3, and AncBE4Max. In some embodiments, the fusion partner protein comprises an amino acid sequence that is at least 75%, at least 80%, at least 85%, at least 90%, at least 95%, at least 98%, at least 99% or 100% identical to any one of SEQ ID NOs: 713, 714, 732 and 733. In some embodiments, the method further comprises contacting the mammalian cells with a guide RNA, wherein the guide RNA comprises a sequence that is at least 75%, at least 80%, at least 85%, at least 90%, at least 95%, at least 98%, at least 99% or 100% identical to any one of SEQ ID NOs: 715-727. In some embodiments, the target nucleic acid comprises B2M, TRAC, CIITA, NGCG_B2M, or any combination thereof.

Also disclosed herein are methods of modifying the expression of a target nucleic acid comprising contacting the mammalian cell with a composition comprising a fusion protein, wherein the fusion protein comprises a fusion partner protein and an effector protein, wherein the effector protein comprises an amino acid sequence that is at least 75%, at least 80%, at least 85%, at least 90%, at least 95%, at least 98%, at least 99% or 100% identical to SEQ ID NO: 728. In some embodiments, the fusion partner protein comprises a transcriptional activator. In some embodiments, the fusion partner protein comprises an amino acid sequence that is at least 75%, at least 80%, at least 85%, at least 90%, at least 95%, at least 98%, at least 99% or 100% identical to SEQ ID NO: 300. In some embodiments, the method further comprises contacting the mammalian cells with a guide RNA, wherein the guide RNA comprises a sequence that is at least 75%, at least 80%, at least 85%, at least 90%, at least 95%, at least 98%, at least 99% or 100% identical to any one of SEQ ID NOs: 647-710. In some embodiments, the target nucleic acid comprises NEUROD1, HBG1, ASCL1, LIN28A, or any combination thereof.

Also disclosed herein are methods of modifying the expression of a target nucleic acid comprising contacting the mammalian cell with a composition comprising a fusion protein, wherein the fusion protein comprises a fusion partner protein and an effector protein, wherein the effector protein comprises an amino acid sequence that is at least 75%, at least 80%, at least 85%, at least 90%, at least 95%, at least 98%, at least 99% or 100% identical to SEQ ID NO: 729. In some embodiments, the fusion partner protein comprises a transcriptional activator. In some embodiments, the fusion partner protein comprises an amino acid sequence that is at least 75%, at least 80%, at least 85%, at least 90%, at least 95%, at least 98%, at least 99% or 100% identical to SEQ ID NO: 300. In some embodiments, the method further comprises contacting the mammalian cells with a guide RNA, wherein the guide RNA comprises a sequence that is at least 75%, at least 80%, at least 85%, at least 90%, at least 95%, at least 98%, at least 99% or 100% identical to any one of SEQ ID NOs: 647-710. In some embodiments, the target nucleic acid comprises NEUROD1, HBG1, ASCL1, LIN28A, or any combination thereof.

Also disclosed herein are methods of modifying the expression of a target nucleic acid comprising contacting the mammalian cell with a composition comprising a fusion protein, wherein the fusion protein comprises a fusion partner protein and an effector protein, wherein the effector protein comprises an amino acid sequence that is at least 75%, at least 80%, at least 85%, at least 90%, at least 95%, at least 98%, at least 99% or 100% identical to SEQ ID NO: 730. In some embodiments, the fusion partner protein comprises a transcriptional activator. In some embodiments, the fusion partner protein comprises an amino acid sequence that is at least 75%, at least 80%, at least 85%, at least 90%, at least 95%, at least 98%, at least 99% or 100% identical to SEQ ID NO: 300. In some embodiments, the method further comprises contacting the mammalian cells with a guide RNA, wherein the guide RNA comprises a sequence that is at least 75%, at least 80%, at least 85%, at least 90%, at least 95%, at least 98%, at least 99% or 100% identical to any one of SEQ ID NOs: 647-710. In some embodiments, the target nucleic acid comprises NEUROD1, HBG1, ASCL1, LIN28A, or any combination thereof.

Also disclosed herein are methods of modifying the expression of a target nucleic acid comprising contacting the mammalian cell with a composition comprising a fusion protein, wherein the fusion protein comprises a fusion partner protein and an effector protein, wherein the effector protein comprises an amino acid sequence that is at least 75%, at least 80%, at least 85%, at least 90%, at least 95%, at least 98%, at least 99% or 100% identical to SEQ ID NO: 731. In some embodiments, the fusion partner protein comprises a transcriptional activator. In some embodiments, the fusion partner protein comprises an amino acid sequence that is at least 75%, at least 80%, at least 85%, at least 90%, at least 95%, at least 98%, at least 99% or 100% identical to SEQ ID NO: 300. In some embodiments, the method further comprises contacting the mammalian cells with a guide RNA, wherein the guide RNA comprises a sequence that is at least 75%, at least 80%, at least 85%, at least 90%, at least 95%, at least 98%, at least 99% or 100% identical to any one of SEQ ID NOs: 647-710. In some embodiments, the target nucleic acid comprises NEUROD1, HBG1, ASCL1, LIN28A, or any combination thereof.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: (i) a crRNA or sgRNA comprising a nucleobase sequence that is at least 75%, at least 80%, at least 85%, at least 90%, at least 95%, or 100% identical to any one of the crRNA or sgRNA sequences of TABLE 13, (ii) a tracrRNA comprising a nucleobase sequence that is at least 75%, at least 80%, at least 85%, at least 90%, at least 95%, or 100% identical to any one of the tracrRNA sequences of TABLE 13, or (iii) a combination thereof Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: (i) a crRNA or sgRNA comprising a nucleobase sequence that is at least 75%, at least 80%, at least 85%, at least 90%, at least 95%, or 100% identical to any one of the crRNA or sgRNA sequences of TABLE 14, (ii) a tracrRNA comprising a nucleobase sequence that is at least 75%, at least 80%, at least 85%, at least 90%, at least 95%, or 100% identical to any one of the tracrRNA sequences of TABLE 14, or (iii) a combination thereof Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 223, 224, or 214 and wherein the engineered guide nucleic acid comprises: (i) a crRNA or sgRNA comprising a nucleobase sequence that is at least 75%, at least 80%, at least 85%, at least 90%, at least 95%, or 100% identical to any one of SEQ ID NOs: 463, 464, or 466, (ii) a tracrRNA comprising a nucleobase sequence that is at least 75%, at least 80%, at least 85%, at least 90%, at least 95%, or 100% identical to SEQ ID NO: 465, or (iii) a combination thereof.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: a crRNA or sgRNA comprising a nucleobase sequence that is at least 75%, at least 80%, at least 85%, at least 90%, at least 95%, or 100% identical to SEQ ID NO: 180 or 467.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: a crRNA or sgRNA comprising a nucleobase sequence that is at least 75%, at least 80%, at least 85%, at least 90%, at least 95%, or 100% identical to any one of the crRNA or sgRNA sequences of SEQ ID NOs: 468-481.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23, and wherein the engineered guide nucleic acid comprises: a crRNA or sgRNA comprising a nucleobase sequence that is at least 75%, at least 80%, at least 85%, at least 90%, at least 95%, or 100% identical to any one of the crRNA or sgRNA sequences of TABLE 18.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: a crRNA or sgRNA comprising a nucleobase sequence that is at least 75%, at least 80%, at least 85%, at least 90%, at least 95%, or 100% identical to any one of the crRNA or sgRNA sequences of TABLE 19.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 1-45, 202-293, or 728-731, and wherein the engineered guide nucleic acid comprises: (i) a crRNA or sgRNA comprising a nucleobase sequence that is at least 75%, at least 80%, at least 85%, at least 90%, at least 95%, or 100% identical to any one of the crRNA or sgRNA sequences of TABLE 20, (ii) a tracrRNA comprising a nucleobase sequence that is at least 75%, at least 80%, at least 85%, at least 90%, at least 95%, or 100% identical to any one of the tracrRNA sequences of TABLE 20, or (iii) a combination thereof.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NOs: 232, 233, 240, or 227, and wherein the engineered guide nucleic acid comprises: a crRNA or sgRNA comprising a nucleobase sequence that is at least 75%, at least 80%, at least 85%, at least 90%, at least 95%, or 100% identical to any one of SEQ ID NOs: 612-615.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 228, and wherein the engineered guide nucleic acid comprises: a sgRNA comprising a nucleobase sequence that is at least 75%, at least 80%, at least 85%, at least 90%, at least 95%, or 100% identical to SEQ ID NO: 616.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to any one of SEQ ID NO: 215, and wherein the engineered guide nucleic acid comprises: (i) a crRNA or sgRNA comprising a nucleobase sequence that is at least 75%, at least 80%, at least 85%, at least 90%, at least 95%, or 100% identical to any one of SEQ ID NOs: 617, 620 or 621, (ii) a tracrRNA comprising a nucleobase sequence that is at least 75%, at least 80%, at least 85%, at least 90%, at least 95%, or 100% identical to any one of SEQ ID NOs: 618-619, or (iii) a combination thereof.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23, and wherein the engineered guide nucleic acid comprises: (i) a crRNA or sgRNA comprising a nucleobase sequence that is at least 75%, at least 80%, at least 85%, at least 90%, at least 95%, or 100% identical to any one of SEQ ID NOs: 68 and 149, (ii) a tracrRNA comprising a nucleobase sequence that is at least 75%, at least 80%, at least 85%, at least 90%, at least 95%, or 100% identical to SEQ ID NO: 120, or (iii) a combination thereof.

Also disclosed herein are compositions comprising an effector protein and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO: 23, and wherein the engineered guide nucleic acid comprises: (i) a crRNA or sgRNA comprising a nucleobase sequence that is at least 75%, at least 80%, at least 85%, at least 90%, at least 95%, or 100% identical to any one of the sgRNA sequences of TABLE 25, (ii) a tracrRNA comprising a nucleobase sequence that is at least 75%, at least 80%, at least 85%, at least 90%, at least 95%, or 100% identical to any one of the tracrRNA sequences of TABLE 25, (iii) a linker sequence comprising a nucleobase sequence that is at least 75%, at least 80%, at least 85%, at least 90%, at least 95%, or 100% identical to any one of the linker sequences of SEQ ID NO: 623, (iv) a spacer sequence comprising a nucleobase sequence that is at least 75%, at least 80%, at least 85%, at least 90%, at least 95%, or 100% identical to any one of the spacer sequences of TABLE 25, (v) a repeat sequence comprising a nucleobase sequence that is at least 75%, at least 80%, at least 85%, at least 90%, at least 95%, or 100% identical to any one of the repeat sequences of TABLE 25, or (vi) a combination thereof.

Also disclosed herein are methods of modifying a target nucleic acid in a sample, comprising contacting the sample with a composition disclosed herein thereby generating a modification of the target nucleic acid; and optionally detecting the modification. In some embodiments, the target nucleic acid comprises a PAM sequence selected from any one of the PAM sequences in TABLE 13, TABLE 14, TABLE 16, TABLE 17, TABLE 20, TABLE 21, TABLE 22, TABLE 23, or TABLE 24. In some embodiments, the target nucleic acid comprises a PAM sequence selected from any one of the PAM sequences in TABLE 13. In some embodiments, the target nucleic acid comprises a PAM sequence selected from any one of the PAM sequences in TABLE 14. In some embodiments, the target nucleic acid comprises a PAM sequence selected from SEQ ID NOs: 368-371. In some embodiments, the target nucleic acid comprises a PAM sequence selected from SEQ ID NOs: 369 and 370. In some embodiments, the target nucleic acid comprises a PAM sequence selected from SEQ ID NOs: 304, 312, 313, 315, 324, and 335. In some embodiments, the target nucleic acid comprises a PAM sequence selected from SEQ ID NOs: 301, 318, 335, 343, 360, and 365. In some embodiments, the target nucleic acid comprises a PAM sequence is SEQ ID NO: 368. In some embodiments, the target nucleic acid comprises a PAM sequence is SEQ ID NO: 343. In some embodiments, the target nucleic acid comprises a PAM sequence selected from SEQ ID NOs: 325-328

Also disclosed herein are systems for detecting or modifying a target sequence of a target nucleic acid comprising: a) a polypeptide, or a nucleic acid encoding the polypeptide; and b) an engineered guide nucleic acid, wherein the polypeptide comprises an amino acid sequence that is at least 85% identical to SEQ ID NO: 23. In some embodiments, the polypeptide comprises an amino acid sequence that is at least 90% identical to SEQ ID NO: 23. In some embodiments, the polypeptide comprises an amino acid sequence that is at least 95% identical to SEQ ID NO: 23. In some embodiments, the polypeptide comprises the sequence of SEQ ID NO: 23. In some embodiments, the engineered guide nucleic acid comprises a sequence that is at least 80% identical to a sequence selected from: SEQ ID NOS: 624, 628, 630, 634, 638, 641, 643, and 645. In some embodiments, the engineered guide nucleic acid comprises a sequence that is at least 95% identical to a sequence selected from: SEQ ID NOS: SEQ ID NOS: 624, 628, 630, 634, 638, 641, 643, and 645. In some embodiments, the polypeptide comprises a mutation that reduces an enzymatic activity of the polypeptide relative to the polypeptide that is 100% identical to SEQ ID NO: 23. In some embodiments, the polypeptide is capable of binding to the target nucleic acid but has reduced or no nuclease activity on the target nucleic acid. In some embodiments, the system comprises a fusion partner protein fused to the polypeptide. In some embodiments, the polypeptide is a nuclease that is capable of cleaving at least one strand of a target nucleic acid. In some embodiments, the system comprises at least one of a detection reagent and an amplification reagent. In some embodiments, the detection reagent is selected from: a reporter nucleic acid, a detection moiety, an additional polypeptide, and a combination thereof. In some embodiments, the one amplification reagent is selected from: a primer, a polymerase, a dNTP, an rNTP, and a combination thereof. In some embodiments, the target nucleic acid comprises a protospacer adjacent motif (PAM) selected from any one of SEQ ID NOS: 156-159, 325-328, and 369, and wherein the PAM is required for the polypeptide and engineered guide nucleic acid to detect or modify the target sequence. In some embodiments, the target nucleic acid comprises a PAM sequence of SEQ ID NO: 369. In some embodiments, the nucleic acid encoding the polypeptide is an expression vector. In some embodiments, the expression vector comprises or encodes the engineered guide nucleic acid. In some embodiments, the expression vector is an adeno-associated viral vector. In some embodiments, the nucleic acid encoding the polypeptide is a messenger RNA. In some embodiments, the system comprises a lipid or lipid nanoparticle.

Also disclosed herein are compositions comprising a polypeptide, or a nucleic acid encoding the polypeptide, and an engineered guide nucleic acid, wherein the polypeptide comprises an amino acid sequence that is at least 90% identical to SEQ ID NO: 23. In some embodiments, the polypeptide comprises an amino acid sequence that is at least 95% identical to SEQ ID NO: 23. In some embodiments, the engineered guide nucleic acid comprises a sequence that is at least 80% identical to a sequence selected from: SEQ ID NOS: 624, 628, 630, 634, 638, 641, 643, and 645. In some embodiments, the engineered guide nucleic acid comprises a sequence that is at least 95% identical to a sequence selected from: SEQ ID NOS: 624, 628, 630, 634, 638, 641, 643, and 645. In some embodiments, the polypeptide is fused to at least one nuclear localization signal. In some embodiments, the polypeptide is capable of binding to a target nucleic acid but has reduced or no nuclease activity on the target nucleic acid. In some embodiments, the composition comprises a fusion partner protein fused to the polypeptide. In some embodiments, the polypeptide is a nuclease that is capable of cleaving at least one strand of a target nucleic acid. In some embodiments, the composition further comprises a target nucleic acid, and wherein the target nucleic acid comprises a PAM sequence selected from any one of SEQ ID NOs: 156-159, 325-328, and 369. In some embodiments, the composition comprises a donor nucleic acid.

Also disclosed herein are compositions comprising an effector protein, or a nucleic acid encoding the effector protein, and an engineered guide nucleic acid, wherein the effector protein comprises an amino acid sequence that is at least 75%, at least 80%, at least 85%, at least 90%, at least 95%, at least 98%, at least 99% or 100% identical to a sequence selected from any one of SEQ ID NOs: 1-45, 202-293, and 728-731. In some embodiments, the engineered guide nucleic acid comprises a sequence selected from: ID Nos: 624, 628, 630, 634, 638, 641, 643, 645, 646, and 827-929. In some embodiments, the effector protein and engineered guide nucleic acid form a complex that recognizes a protospacer adjacent motif selected from TABLE 39. In some embodiments, the effector protein comprises an amino acid sequence that is at least 95% identical to a sequence selected from any one of SEQ ID NOs: 1-45, 202-240, and 728-731. In some embodiments, the effector protein comprises an amino acid sequence selected from SEQ ID NOS: 241-293. In some embodiments, the engineered guide nucleic acid is a single guide RNA. In some embodiments, the composition comprises a nuclear localization signal linked to the effector protein. In some embodiments, the length of the effector protein is about 380 to about 500 linked amino acids. In some embodiments, a fusion partner protein fused to the effector protein. In some embodiments, the effector protein is a nuclease that can cleave at least one strand of a target nucleic acid. In some embodiments, the effector protein is a nuclease that can cleave both strands of a double stranded target nucleic acid. In some embodiments, the composition comprises at least one of a detection reagent and an amplification reagent. In some embodiments, detection reagent is selected from: a reporter nucleic acid, a detection moiety, an additional polypeptide, and a combination thereof. In some embodiments, the one amplification reagent is selected from: a primer, a polymerase, a dNTP, an rNTP, and a combination thereof. In some embodiments, the nucleic acid encoding the effector protein is an expression vector. In some embodiments, the expression vector comprises or encodes the engineered guide nucleic acid. In some embodiments, the expression vector is an adeno-associated viral vector. In some embodiments, the nucleic acid encoding the effector protein is a messenger RNA. In some embodiments, the composition comprises a lipid or lipid nanoparticle. In some embodiments, the composition comprises a donor nucleic acid. In some embodiments, the engineered guide nucleic acid comprises a first sequence, wherein the effector protein can bind the first sequence; and a second sequence that hybridizes to a target sequence of a target nucleic acid. In some embodiments, the target sequence is a eukaryotic sequence Also disclosed herein are compositions comprising an effector protein, or a nucleic acid encoding the effector protein, and an engineered guide nucleic acid, wherein the effector protein comprises an amino acid sequence that is at least 75%, at least 80%, at least 85%, at least 90%, at least 95%, at least 98%, at least 99% or 100% identical to SEQ ID NO 23. In some embodiments, the effector protein comprises an amino acid sequence that is at least 95% identical to SEQ ID NO: 23. In some embodiments, the effector protein comprises the sequence of SEQ ID NO: 23. In some embodiments, the engineered guide nucleic acid comprises a sequence that is at least 80% identical to a sequence selected from: SEQ ID NOS: 624, 628, 630, 634, 638, 641, 643, 645, 646, and 855-873. In some embodiments, the engineered guide nucleic acid comprises a sequence that is at least 95% identical to a sequence selected from: SEQ ID NOS: 624, 628, 630, 634, 638, 641, 643, 645, and 855-873. In some embodiments, the engineered guide nucleic acid comprises a sequence that is at least 80% identical to a sequence selected from: SEQ ID NOS: 645, 932, 857, 933, 934, 935, 936, 737, 747, 750, 761, 763, 765, 769, 773, 780, 782, or 785. In some embodiments, the engineered guide nucleic acid comprises a sequence that is at least 95% identical to a sequence selected from: SEQ ID NOS: 645, 932, 857, 933, 934, 935, 936, 737, 747, 750, 761, 763, 765, 769, 773, 780, 782, or 785. In some embodiments, the engineered guide nucleic acid comprises a sequence that is at least 80% identical to SEQ ID NO: 645. In some embodiments, the engineered guide nucleic acid comprises a sequence that is at least 95% identical to SEQ ID NO: 645. In some embodiments, the effector protein and engineered guide nucleic acid form a complex that recognizes a protospacer adjacent motif selected from: TCG, and KYG. In some embodiments, the effector protein comprises a mutation that reduces an enzymatic activity of the polypeptide relative to the polypeptide that is 100% identical to SEQ ID NO: 23. In some embodiments, the effector protein is capable of binding to the target nucleic acid but has reduced or no nuclease activity on the target nucleic acid. In some embodiments, the amino acid sequence of the effector protein comprises one or more amino acid alterations. In some embodiments, the amino acid sequence of the effector protein comprises one or more amino acid alterations in a domain selected from a REC domain and a RuvC domain. In some embodiments, the one or more amino acid alterations are selected from: A110R, T111R, E112R, M113R, S114R, T115R, Q116R, S117R, L118R, S119R, F122R, A123R, T124R, E125R, L126R, E127R, T128R, N129R, I130R, F131R, A132R, K261R, V263R, V264R, G265R, V266R, D267R, D267A, D267N, L268R, G269R, I270R, N271R, V272R, P273R, A274R, Y275R, V276R, A277R, T278R, N279R, I280R, T281R, E282R, E363Q, I457R, A458R, N459R, S460R, K461R, D462R, I463R, I464R, K466R, N467R, E468R, and any combination thereof, relative to SEQ ID NO: 23. In some embodiments, the engineered guide nucleic acid is a single guide RNA. In some embodiments, the composition comprises a nuclear localization signal linked to the effector protein. In some embodiments, the length of the effector protein is about 380 to about 500 linked amino acids. In some embodiments, a fusion partner protein fused to the effector protein. In some embodiments, the effector protein is a nuclease that can cleave at least one strand of a target nucleic acid. In some embodiments, the effector protein is a nuclease that can cleave both strands of a double stranded target nucleic acid. In some embodiments, the composition comprises at least one of a detection reagent and an amplification reagent. In some embodiments, detection reagent is selected from: a reporter nucleic acid, a detection moiety, an additional polypeptide, and a combination thereof. In some embodiments, the one amplification reagent is selected from: a primer, a polymerase, a dNTP, an rNTP, and a combination thereof. In some embodiments, the nucleic acid encoding the effector protein is an expression vector. In some embodiments, the expression vector comprises or encodes the engineered guide nucleic acid. In some embodiments, the expression vector is an adeno-associated viral vector. In some embodiments, the nucleic acid encoding the effector protein is a messenger RNA. In some embodiments, the composition comprises a lipid or lipid nanoparticle. In some embodiments, the composition comprises a donor nucleic acid. In some embodiments, the engineered guide nucleic acid comprises a first sequence, wherein the effector protein can bind the first sequence; and a second sequence that hybridizes to a target sequence of a target nucleic acid. In some embodiments, the target sequence is a eukaryotic sequence.

Also disclosed herein are systems or kits comprising one or more components of any one of the compositions disclosed above, wherein the one or more components of the system are separate.

Also disclosed herein are pharmaceutical compositions, comprising the composition disclosed above and a pharmaceutically acceptable excipient.

Also disclosed herein are methods of modifying a target nucleic acid in a sample, comprising contacting the sample with a composition disclosed above or the system disclosed above, thereby generating a modification of the target nucleic acid; and optionally detecting the modification.

Also disclosed herein are methods of detecting a target nucleic acid in a sample, comprising the steps of: contacting the sample with: (i) the composition disclosed above or the system disclosed above; and (ii) a reporter nucleic acid comprising a detectable moiety that produces a detectable signal in the presence of the target nucleic acid and the composition or system, and detecting the detectable signal. In some embodiments, the method comprises contacting the target nucleic acid with a donor nucleic acid.

Also disclosed herein are cells comprising the compositions disclosed above. Also disclosed herein are cells produced by methods disclosed above. In some embodiments, the cell is a eukaryotic cell. In some embodiments, the cell is a mammalian cell. In some embodiments, the cell is a T cell, optionally wherein the T cell is a natural killer T cell (NKT). In some embodiments, the cell is an induced pluripotent stem cell (iPSC). Also disclosed herein are populations of cells.

Also disclosed herein are methods of treating or preventing a disease comprising administering to a subject in need thereof a composition, a pharmaceutical composition or a cell disclosed above.

Also disclosed herein are compositions comprising an effector protein, or a nucleic acid encoding the effector protein, and a guide nucleic acid, or a nucleic acid encoding the guide nucleic acid, wherein the effector protein comprises an amino acid sequence that is (a) at least 50%, at least 60%, at least 70%, at least 75%, at least 80%, at least 85%, at least 90%, at least 95%, at least 98%, at least 99% or 100% identical to SEQ ID NO: 23 and (b) includes an amino acid sequence selected from the group: (a) an amino acid sequence that is at least 60%, at least 70%, at least 80%, at least 90%, at least 95%, at least 98%, at least 99% or 100% identical to SEQ ID NO: 793, (b) an amino acid sequence that is at least 60%, at least 70%, at least 80%, at least 90%, at least 95%, at least 98%, at least 99% or 100% identical to SEQ ID NO: 794, (c) an amino acid sequence that is at least 60%, at least 70%, at least 80%, at least 90%, at least 95%, at least 98%, at least 99% or 100% identical to SEQ ID NO: 795, (d) an amino acid sequence that is at least 60%, at least 70%, at least 80%, at least 90%, at least 95%, at least 98%, at least 99% or 100% identical to SEQ ID NO: 796, (e) an amino acid sequence that is at least 60%, at least 70%, at least 80%, at least 90%, at least 95%, at least 98%, at least 99% or 100% identical to SEQ ID NO: 797, (f) an amino acid sequence that is at least 60%, at least 70%, at least 80%, at least 90%, at least 95%, at least 98%, at least 99% or 100% identical to SEQ ID NO: 798, and (g) an amino acid sequence that is at least 60%, at least 70%, at least 80%, at least 90%, at least 95%, at least 98%, at least 99% or 100% identical to SEQ ID NO: 799, and wherein the effector protein interacts with the guide nucleic acid to form a complex that is targeted to a target sequence via base pairing between the guide nucleic acid and the target sequence.

Also disclosed herein are composition comprising an effector protein, or a nucleic acid encoding the effector protein, and a guide nucleic acid, or a nucleic acid encoding the guide nucleic acid, wherein the effector protein comprises a sequence of amino acids that is at least 37%, at least 40%, at least 50%, at least 60%, at least 70%, at least 80%, at least 90%, at least 95%, at least 98%, at least 99% or 100% identical to SEQ ID NO: 796, and wherein the effector protein interacts with the guide nucleic acid to form a complex that is targeted to a target sequence via base pairing between the guide nucleic acid and the target sequence.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIGS. 7A-7E illustrate PAM preferences for different D2S effector proteins disclosed herein generated from in vitro enrichment (*E. coli* and mammalian) as described in Examples 5, 6, 12, and 13. Frequency of nucleotides at each PAM position was independently calculated using a position frequency matrix (PFM) and plotted as a WebLogo. The numbers and the bottom of each plot correspond to the D2S effector protein used as well as the combination of crRNA, sgRNA, and/or tracrRNA sequences.

FIG. 8A is the change in gene expression by CasM.286251 (D267A) with an N terminal VPR fused by an XTEN10 linker. FIG. 8B is the change in gene expression by CasM.19952 (D267A) with an N terminal VPR fused by an XTEN10 linker. FIG. 8C is the change in gene expression by CasM.19952 (D267N) with an N terminal VPR fused by an XTEN10 linker. FIG. 8D is the change in gene expression by CasM.19952 (E363Q) with an N terminal VPR fused by an XTEN10 linker. The Y-axis shows the relative fold change of RNA levels. The X-axis shows the guide sequences tested. NT denotes a guide with the enzyme's repeat, but a scramble sequence spacer, gpool8 is a pooled control the guides, and dCas9 is a catalytically inactive "dead" Cas9.

FIG. 9 illustrates the constructs used for base editing of different target genes. The C and N term indicates the location of base editing effector relative to the dCASM.19952 (D267A) protein. The CBE/ABE indicate the location of the effector. The XTEN is the linker used (e.g., XTEN10, XTEN40 or XTEN80). The tagBFP indicates a blue fluorescent protein and t2A indicates a self-cleaving peptide sequence. FIG. 9 at the bottom shows the indel percentage of catalytically active CasM.19952 and gRNAs at respective target sites.

FIG. 10A shows the ABE8e-XTEN10-dCasM.19952 (D267A) construct editing of CIITA t26. The editing appeared at position A9 (about 0.94% of As were changed to Gs). Figure discloses SEQ ID NO: 958. FIG. 10B shows the AncBE4Max-XTEN10-dCasM.19952(D267A) construct editing of CIITA t26. The editing appeared at positions C6 and C8 (about 0.70-0.75% of Cs were changed to Ts). The editing at C18 is believed to have occurred from experimental noise. Figure discloses SEQ ID NO: 958.

FIG. 11A-11B show the conserved motifs that are shared by D2S effector proteins. FIG. 11A shows weblogos of the multilevel consensus sequences of the conserved motifs. Weblogos corresponding to MEME_1, MEME_2, MEME_3, MEME_4, MEME_5, MEME_6 and MEME_7 are shown to the right of the "MEME" descriptor. FIG. 11B shows the location of the detected motifs in the D2S effector proteins. MEME 1-7 corresponding to SEQ ID NOS: 949-955, respectively, are depicted.

DETAILED DESCRIPTION OF THE INVENTION

Figure 1:
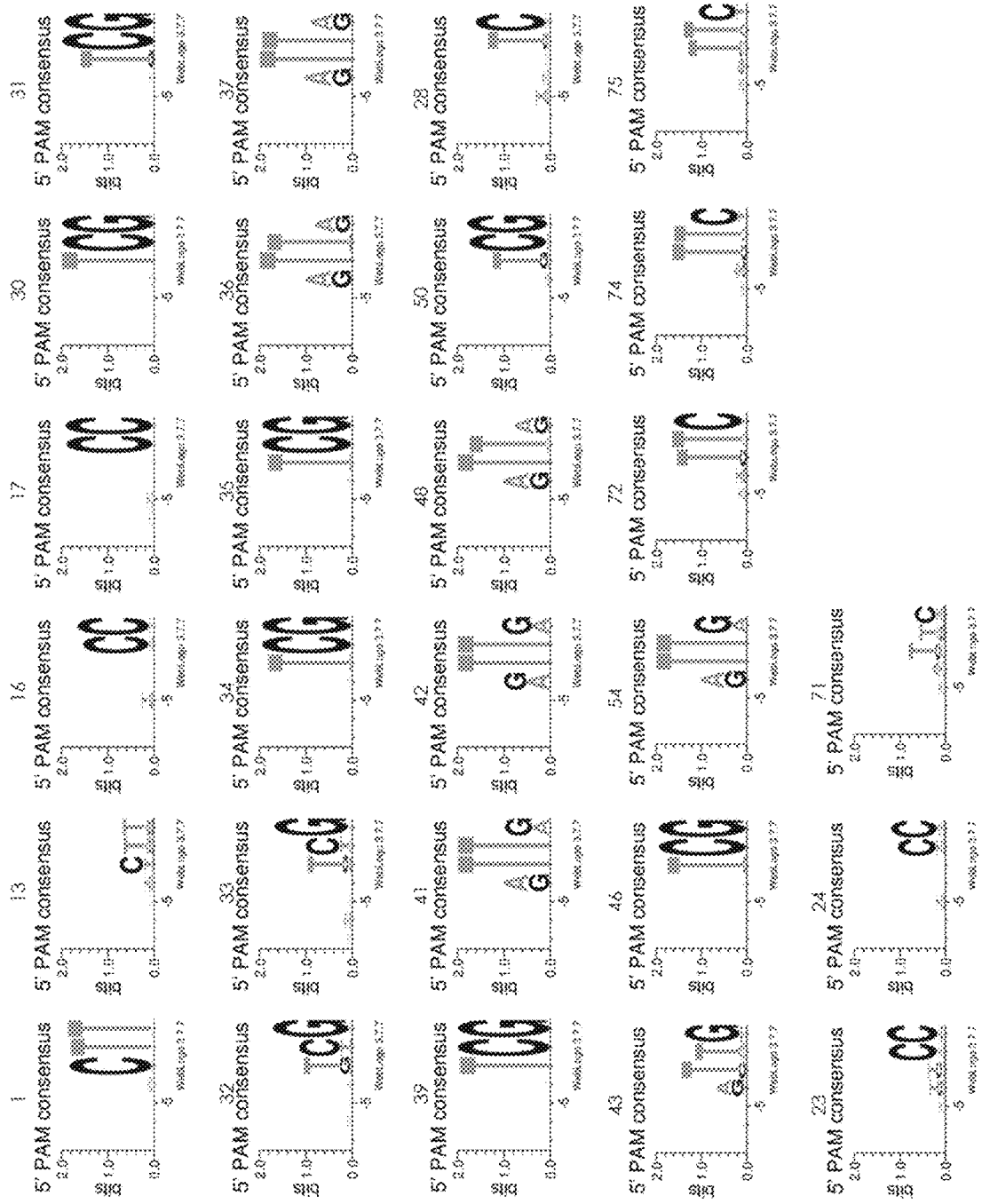
FIG. 1 illustrates PAM preferences for different D2S effector proteins disclosed herein. Frequency of nucleotides at each PAM position was independently calculated using a position frequency matrix (PFM) and plotted as a WebLogo. The number at the top of the plot corresponds to the composition number of TABLE 2 and TABLE 3, denoting the D2S effector protein used, as well as the combination of crRNA, sgRNA, and/or tracrRNA sequence.

It is to be understood that both the foregoing general description and the following detailed description are exemplary and explanatory only and are not restrictive of the disclosure. Herein, the use of the singular includes the plural unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference in their entirety for any purpose.

II. Definitions

Unless otherwise indicated, all technical terms used herein have the same meaning as commonly understood by one of ordinary skill in the art to which this invention belongs. Unless otherwise indicated or obvious from context, the following terms have the following meanings:

As used herein, the use of "or" means "and/or" unless stated otherwise. Furthermore, the use of the term "including" as well as other forms, such as "includes" and "included", is not limiting.

"Percent identity," "% identity," and % "identical" refers to the extent to which two sequences (nucleotide or amino acid) have the same residue at the same positions in an alignment. For example, "an amino acid sequence is X % identical to SEQ ID NO: Y" can refer to % identity of the amino acid sequence to SEQ ID NO: Y and is elaborated as X % of residues in the amino acid sequence are identical to the residues of sequence disclosed in SEQ ID NO: Y. Generally, computer programs can be employed for such calculations. Illustrative programs that compare and align pairs of sequences, include ALIGN (Myers and Miller, Comput Appl Biosci. 1988 March; 4(1):11-7), FASTA (Pearson and Lipman, Proc Natl Acad Sci USA. 1988 April; 85(8):2444-8; Pearson, Methods Enzymol. 1990; 183:63-98) and gapped BLAST (Altschul et al., Nucleic Acids Res. 1997 Sep. 1; 25(17):3389-40), BLASTP, BLASTN, or GCG (Devereux et al., Nucleic Acids Res. 1984 Jan. 11; 12(1 Pt 1):387-95).

When comparing two protein sequences, it may be useful to not only look at the percent identity between the aligned sequences, but also at their percent similarity. Certain amino acid substitutions are considered more conservative than others; two amino acids may share characteristics such as electrochemical properties. In these cases, substituting the amino acid may not significantly affect the structure or function of the protein. Therefore, the sequences' % identity may not accurately describe their similarity. Additionally, protecting protein sequences solely on identity runs the risk of other parties skilled in the art making conservative amino acid substitutions (e.g. changing every leucine to an isoleucine) and still obtaining a functional protein. In some instances, compositions and methods disclosed herein comprise an effector protein, or a use thereof, that is substantially similar to an effector protein sequence disclosed herein. Example 25 describes an exemplary method for calculating % similarity.

As used in the specification and claims, the singular forms "a", "an" and "the" include plural references unless the context clearly dictates otherwise. For example, the term "a sample" includes a plurality of samples, including mixtures thereof.

Unless specifically stated or obvious from context, as used herein, the term "about" in reference to a number or range of numbers is understood to mean the stated number and numbers+/−10% thereof, or 10% below the lower listed limit and 10% above the higher listed limit for the values listed for a range.

The term "alteration" as used herein can refer to the insertion, deletion, or substitution of an amino acid in an amino acid sequence at a position identified relative to a reference or parent sequence.

As used herein, the term "comprising" and its grammatical equivalents specifies the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

The terms "determining," "measuring," "evaluating," "assessing," "assaying," and "analyzing" are often used interchangeably herein to refer to forms of measurement. The terms include determining if an element is present or not (for example, detection). These terms can include quantitative, qualitative or quantitative and qualitative determinations. Assessing can be relative or absolute. "Detecting the presence of" can include determining the amount of something present in addition to determining whether it is present or absent depending on the context.

As used herein, a "catalytically inactive effector protein" refers to an effector protein that is modified relative to a naturally-occurring effector protein to have a reduced or eliminated catalytic activity relative to that of the naturally-occurring effector protein, but retains its ability to interact with a guide nucleic acid. The catalytic activity that is reduced or eliminated is often a nuclease activity. The naturally-occurring effector protein may be a wildtype protein. The catalytically inactive effector protein can be referred to as a catalytically inactive variant of an effector protein, e.g., a Cas effector protein.

The term "in vivo" is used to describe an event that takes place in a subject's body. The term "ex vivo" is used to describe an event that takes place outside of a subject's body. An ex vivo assay is not performed on a subject. Rather, it is performed upon a sample separate from a subject. An example of an ex vivo assay performed on a sample is an "in vitro" assay. The term "in vitro" is used to describe an event that takes places contained in a container for holding laboratory reagent such that it is separated from the biological source from which the material is obtained. In vitro assays can encompass cell-based assays in which living or dead cells are employed. In vitro assays can also encompass a cell-free assay in which no intact cells are employed.

As used herein, the terms "treatment" or "treating" are used in reference to a pharmaceutical or other intervention regimen for obtaining beneficial or desired results in the recipient. Beneficial or desired results include but are not limited to a therapeutic benefit and/or a prophylactic benefit. A therapeutic benefit may refer to eradication or amelioration of symptoms or of an underlying disorder being treated. Also, a therapeutic benefit can be achieved with the eradication or amelioration of one or more of the physiological symptoms associated with the underlying disorder such that an improvement is observed in the subject, notwithstanding that the subject may still be afflicted with the underlying disorder. A prophylactic effect includes delaying, preventing, or eliminating the appearance of a disease or condition, delaying or eliminating the onset of symptoms of a disease or condition, slowing, halting, or reversing the progression of a disease or condition, or any combination thereof. For prophylactic benefit, a subject at risk of developing a particular disease, or to a subject reporting one or more of the physiological symptoms of a disease may undergo treatment, even though a diagnosis of this disease may not have been made.

A "genetic disease", as used herein, refers to a disease caused by one or more mutations in the DNA of an organism. In some instances, a disease is referred to as a "disorder." Mutations may be due to several different cellular mechanisms, including, but not limited to, an error in DNA replication, recombination, or repair, or due to environmental factors. Mutations may be encoded in the sequence of a target nucleic acid from the germline of an organism. A genetic disease may comprise a single mutation, multiple mutations, or a chromosomal aberration.

The term "variant" when used in reference to any amino acid or nucleic acid described herein refers to a sequence having a variation or alteration at an amino acid position or nucleic acid position as compared to a parent sequence. The parent sequence can be, for example, an unmodified, wild-type sequence, a homolog thereof or a modified variant of, for example, a wild-type sequence or homolog thereof.

III. Introduction

Disclosed herein are non-naturally occurring compositions and systems comprising an effector protein (e.g., a D2S effector protein), which can be referred to herein as an effector polypeptide, and an engineered guide nucleic acid, which may simply be referred to herein as a guide nucleic acid. In general, an engineered effector protein and an engineered guide nucleic acid refer to an effector protein and a guide nucleic acid, respectively, that are not found in nature. In some instances, systems and compositions comprise at least one non-naturally occurring component. For example, compositions and systems may comprise a guide nucleic acid, wherein the sequence of the guide nucleic acid is different or modified from that of a naturally-occurring guide nucleic acid. In some instances, compositions and systems comprise at least two components that do not naturally occur together. For example, compositions and systems may comprise a guide nucleic acid comprising a repeat region and a spacer region which do not naturally occur together. Also, by way of example, composition and systems may comprise a guide nucleic acid and an effector protein that do not naturally occur together. Conversely, and for clarity, a D2S effector protein or guide nucleic acid that is "natural," "naturally-occurring," or "found in nature" includes D2S effector proteins and guide nucleic acids from cells or organisms that have not been genetically modified by a human or machine. The effector protein may be a Cas protein (i.e., an effector protein of a CRISPR-Cas system).

In some embodiments, an effector protein comprises a protein that is capable of modifying a nucleic acid molecule (e.g., by cleavage, editing, deamination, methylation, demethylation, oxidation, acetylation, deacetylation, or recombination). Such modifications may modulate the expression of the RNA and/or protein encoded by the nucleic acid molecule (e.g., increasing or decreasing the expression of a nucleic acid molecule). In some embodiments, modifying a nucleic acid molecule, such as a target nucleic acid molecule, comprises editing the nucleic acid molecule (e.g., deleting one or more nucleotides of the nucleic acid molecule, inserting one or more nucleotides into the nucleic acid molecule, mutating one or more nucleotides of the nucleic acid molecule), modulating the expression of the RNA and/or protein encoded by the nucleic acid molecule (e.g., increasing or decreasing the expression of a nucleic acid molecule, for example RNA), making epigenetic modifications of the nucleic acid (e.g., methylation, demethylation, acetylation, or deacetylation), or any combination thereof. Modifying can comprise the activity of the fusion partner of an effector protein. For example, an effector protein comprising a fusion partner can have the activity of increasing or decreasing the expression of the RNA and/or the protein of a target nucleic acid.

In some embodiments, guide nucleic acid comprises a nucleic acid comprising: a first nucleotide sequence that hybridizes to a target nucleic acid; and a second nucleotide sequence that is capable of being connected to a programmable nuclease by, for example, being non-covalently bound by a programmable nuclease or hybridized to a separate nucleic acid molecule that is bound by a programmable nuclease. The first sequence may be referred to herein as a spacer sequence. The second sequence may be referred to herein as a repeat sequence. In some instances, the first sequence is located 5' of the second nucleotide sequence. In some instances, the first sequence is located 3' of the second nucleotide sequence.

In some instances, the guide nucleic acid comprises a non-natural nucleobase sequence. In some instances, the non-natural sequence is a nucleobase sequence that is not found in nature. The non-natural sequence may comprise a portion of a naturally-occurring sequence, wherein the portion of the naturally-occurring sequence is not present in nature, absent the remainder of the naturally-occurring sequence. In some instances, the guide nucleic acid comprises two naturally-occurring sequences arranged in an order or proximity that is not observed in nature. In some instances, compositions and systems comprise a ribonucleotide complex comprising an effector protein and a guide nucleic acid that do not occur together in nature. Engineered guide nucleic acids may comprise a first sequence and a second sequence that do not occur naturally together. For example, an engineered guide nucleic acid may comprise a sequence of a naturally-occurring repeat region and a spacer region that is complementary to a naturally-occurring eukaryotic sequence. The engineered guide nucleic acid may comprise a sequence of a repeat region that occurs naturally in an organism and a spacer region that does not occur naturally in that organism. An engineered guide nucleic acid may comprise a first sequence that occurs in a first organism and a second sequence that occurs in a second organism, wherein the first organism and the second organism are different. The guide nucleic acid may comprise a third sequence located at a 3' or 5' end of the guide nucleic acid, or between the first and second sequences of the guide nucleic acid. For example, an engineered guide nucleic acid may comprise a naturally occurring CRISPR RNA (crRNA) and trans-activating crRNA (tracrRNA) coupled by a linker sequence.

In some embodiments, CRISPR RNA or crRNA is a type of guide nucleic acid, wherein the nucleic acid is RNA comprising a first sequence, often referred to herein as a spacer sequence, that hybridizes to a target sequence of a target nucleic acid, and a second sequence that is capable of being connected to an programmable nuclease by either a) hybridization to a portion of a tracrRNA or b) being non-covalently bound by a programmable nuclease. In some embodiments, the crRNA is covalently linked to an additional nucleic acid (e.g., a tracrRNA) that is bound by the programmable nuclease. In some embodiments, the crRNA and a tracrRNA are in a dual guide system and are not linked by a covalent bond. In such a dual guide system, the crRNA can be connected to the programmable nuclease by hybridization to a portion of the tracrRNA, and the tracrRNA includes a separate portion that is bound by the programmable nuclease.

In some instances, compositions and systems described herein comprise an engineered effector protein that is similar to a naturally occurring D2S effector protein. In some instances, the engineered effector protein and/or a naturally occurring D2S effector protein is referred to as a polypeptide. The engineered effector protein may lack a portion of the naturally occurring D2S effector protein. The D2S effector protein may comprise a mutation relative to the naturally-occurring D2S effector protein, wherein the mutation is not found in nature. The D2S effector protein may also comprise at least one additional amino acid relative to the naturally-occurring D2S effector protein.

For example, the D2S effector protein may comprise an addition of a nuclear localization signal (NLS) relative to the natural occurring D2S effector protein.

In certain embodiments, the nucleotide sequence encoding the effector protein is codon optimized (e.g., for expression in a eukaryotic cell) relative to the naturally occurring sequence.

In some instances, compositions and systems provided herein further comprise a modified host cell comprising one or more D2S effector protein, engineered guide nucleic acids, and/or nucleic acids encoding the same.

IV. Effector Proteins

In some embodiments, an effector protein comprises a protein, polypeptide, or peptide that non-covalently binds to a guide nucleic acid to form a complex that contacts a target nucleic acid, wherein at least a portion of the guide nucleic acid hybridizes to a target sequence of the target nucleic acid. A complex between an effector protein and a guide nucleic acid can include multiple effector proteins or a single effector protein. In some instances, the effector protein modifies the target nucleic acid when the complex contacts the target nucleic acid. In some instances, the effector protein does not modify the target nucleic acid, but it is fused to a fusion partner protein that modifies the target nucleic acid when the complex contacts the target nucleic acid. A non-limiting example of an effector protein modifying a target nucleic acid is cleaving of a phosphodiester bond of the target nucleic acid. Additional examples of modifications an effector protein can make to target nucleic acids are described herein and throughout.

An effector protein may be brought into proximity of a target nucleic acid in the presence of a guide nucleic acid when the guide nucleic acid includes a nucleotide sequence that is complementary with a target sequence in the target nucleic acid. The ability of an effector protein to modify a target nucleic acid may be dependent upon the effector protein being bound to a guide nucleic acid and the guide nucleic acid being hybridized to a target nucleic acid. An effector protein may also recognize a protospacer adjacent motif (PAM) sequence present in the target nucleic acid, which may direct the modification activity of the effector protein. One of skill in the art understands that the phrase, "an effector protein recognizes a PAM sequence," may mean that the effector protein when complexed with a guide nucleic acid, is capable of binding and optionally modifying a target nucleic acid. An effector protein may modify a nucleic acid by cis cleavage or trans cleavage. The modification of the target nucleic acid generated by an effector protein may, as a non-limiting example, result in modulation of the expression of the nucleic acid (e.g., increasing or decreasing expression of the nucleic acid) or modulation of the activity of a translation product of the target nucleic acid (e.g., inactivation of a protein binding to an RNA molecule or hybridization). An effector protein may be a CRISPR-associated ("Cas") protein. An effector protein may function as a single protein, including a single protein that is capable of binding to a guide nucleic acid and modifying a target nucleic acid. Alternatively, an effector protein may function as part of a multiprotein complex, including, for example, a complex having two or more effector proteins, including two or more of the same effector proteins (e.g., dimer or multimer). An effector protein, when functioning in a multiprotein complex, may have only one functional activity (e.g., binding to a guide nucleic acid), while other effector proteins present in the multiprotein complex are capable of the other functional activity (e.g., modifying a target nucleic acid). An effector protein may be a modified effector protein having reduced modification activity (e.g., a catalytically defective effector protein) or no modification activity (e.g., a catalytically inactive effector protein). Accordingly, an effector protein as used herein encompasses a modified or programmable nuclease that does not have nuclease activity.

Provided herein, in certain embodiments, are compositions that comprise one or more D2S effector proteins. TABLE 1 provides illustrative amino acid sequences of D2S effector proteins. In some instances, the amino acid sequence of the D2S effector protein is at least 65%, at least 70%, at least 75%, at least 80%, at least 85%, at least 90%, at least 95%, at least 97%, or at least 98%, at least 99%, or 100% identical to any one of SEQ ID NOs: 1-45, and 202-240. In some instances, the amino acid sequence of the D2S effector protein is at least 65%, at least 70%, at least 75%, at least 80%, at least 85%, at least 90%, at least 95%, at least 97%, or at least 98%, at least 99%, or 100% similar to any one of SEQ ID NOs: 1-45, and 202-240.

TABLE 1

Exemplary Amino Acid Sequences of Effector Proteins

| SEQ ID NO: Effector Protein Name | Effector Protein Amino Acid sequence |
| --- | --- |
| 1<br>CasM.298706 | MAKKGTNRKKMIVKVMKYELKYESGCADFNEMQNELWKLQRQTREVMNR<br>TIQLCYHWSYVQADYCKQHGCARRDVKPCDVYETNATSLDGYIYQLFKDEY<br>PNFLMANLIATLRKAHQKYDALLFDIQEGNSSIPSFKKDQPLIFSKEAIRLPECL<br>SDKRQITLFCFSKPYKSAHPTLDKITFAVRARSASEKSIFDHIISGKYALGESQL<br>VYEKKKWFFLLSYKFTPESVDVNPEKVLGVDLGVVNALCAGSVENPHDSLFI<br>KGTEAIEQIRRLEARKRDLQKQARYPGDGRIGHGTKTRVSPVYQTRDAIARM<br>QDTLNHRWSRALIDFACKKGYGTIQMEDLSGIKALESEKPYLKHWTYFDLQS<br>KIIYKAEEKGIRVVKVNPKCTSRRCSACGYISKENRKNQVEFLCVNCGYHHN<br>ADYNAAQNLSIPQIDRLIEKQLKEQESEENEAGANPK |
| 2<br>CasM.280604 | MAKGTLSKVMKYELRYLDGCGDFQNMQKELWTLQRQSREILNRTIQIAYHW<br>DYTDREQFKKTGQHLDIKAETGYKRLDGYIYDSLKEDVQNFASVNVNATIQK<br>AWAKYKSSKIDVLRGDMSLPSYKSDQPLVLHAQSMKIFSSDDDDVLQVTLFS<br>NAYKKACNYSNIRFIIGLHDATQRTIIKKVLSGDWGIGQSQIVYKRPKWFLYL<br>TYNFSPEQHEVNPDKILGVDLGESIAIYASSIGEYGSLRIEGGEISAFAKQLEAR<br>KRSLQKQAAYCGKGRIGHGTKSRVSDVYKMEDKIANFRNTVNHRYSKMLID<br>YALKHMYGTIQMEDLSGIKKETGFPKFLQHWTYYDLQQKIEAKAKEHGINFI<br>KVDPAFTSQRCSKCGNIDSENRPSQAVFCCKKCGYKTNADFNAS |
| 3<br>CasM.281060 | MNVTKVMRYQLIYQGGGGDFESLQNQLWEFQRQTRAILNKTIQTMYLATAN<br>QEKFSEKALYHDLCAEYPDMISSTVNATLREATKKYRSSVREILAGRMSLPSY<br>KRDHPILLHNQSVALKQGNQGSYFATISVFSRKYQQGTPGVKQPSFQLIAKDN<br>TQRTILQRLLSGEYKLGQCQLIYIRPKWFLNVAYSFTPSEKALDQEKVLGVDL<br>GCVYAIYASSYGNHGIFKISGDEITSFERKQAAIQNRAFKNDLTRIREIEERRKQ<br>KLEQARYCGEGRIGHGVKTRVAPAYQDEGKISRFRETINHRYSKALVDYAEK<br>NGYGTIQMEDLSGIKSSTGFPKRLQHWTYFDLQQKIKYKAEEQGIKVVKIKPA<br>YTSQRCSRCGHIDPANRKSQSEFKCIACGFSSNADYNASQNISMRNIEKIIQGK<br>AN |
| 4<br>CasM.284933 | MAKGTITKVMKYELRYLGGFSDFHEMQKEVWQLQRQYREILNKTIQIALHW<br>DYVSAQQFGESGTYLDIREETGYKTLDGYIYNCLKGAYSEMASANLNAAVQ<br>KAWKKYKNSKTQVLQGVMSLPSYKSDQPILIDKGNVKLSAEENNGRAVLTL<br>FSRNYRDTRGLKGNVEFSVLLHDGTQKSIFRNLIDKTYALGQCQLVYERKKW<br>FLLLTYSFTPAGHALDPEKILGVDLGECYALYASSCYAPGILKIEGGEIAEYAL<br>RLEKRKRSLQQQARYCGEGRIGHGTKTRVGVVYKAEDRIASFRETINHRYSK<br>ELVDYAVSNGYGTIQMEDLSAIQKDLGFPKRLRHWTYYDLQMKITNKAKEH<br>GIAVVKIDPRYTSQRCSKCGHIDPANRPRQEEFCCTACGYACNADYNASQNIS<br>IKGIEKIIQKMLSAKAD |

TABLE 1-continued

Exemplary Amino Acid Sequences of Effector Proteins

| SEQ ID NO: Effector Protein Name | Effector Protein Amino Acid sequence |
|---|---|
| 5 CasM.287908 | MSKGMLTKVMKYTLRYVGGCGDFHEMQSILWELQKQTRAVLNKTIQIAFEW DYRSREAFQETGEYLDVHAETGYKRLDGYIYNCLKNEYADFAGKNLNAAIQ TAWKKYNQSKRDIQTGKMSLPSYRSNQPLIIHNDNVMISQDMQAAPSVRFTL LSLEYKKAHDLNTNPTFEVLINDGTQRAIFEKVRSGEYKLGQCMIQYDKKKW FLLLTYSFQPEKLTLDKNKILGVDLGETIVICASSVSERGRFVIDGGEITRFATQ IEARKRSQQHQAAYCGEGRIGHGTKTRVDAVYKTEDRIANFRDTINHRYSRA LVNYAVKHGFGTIQMEDLSGIKSSDDFPKFLRHWTYYDLQSKIESKAKERGIA VVKVNPRFTSRRCSKCGYIDEGNRKDQAHFCCLSCGFRANADFNASQNLSIK GIDKIIEKEYNANSKQT |
| 6 CasM.288518 | MGKPITKTMKYQIHYIDGCGDFHNMQKELWDLQRIVRQILNKTINESYLWFV RSEQYYRDTGENLSVEEQTGYKTLDGHIYNLLKQEYTQKLVSNSLNASIQAA YKKMKDSRRDVMIGTMSLPSYRSDQPIIIYNKNIKFSSHPEHGFVVDCSLFSDA YKKSQGYEKSVKFQVSVDDNTQRSIFENILTGNYKHGQCSIVYEKKKWFLLL TYSFVPEETKLDPDKILGVDVGVVYALYASSKGNHGTFKIKGDEAITFIQRVE ARKHSRQLQGTYCGDGRIGHGTKTRVQPVYNERALISNFQDTINHRYSKALI DYAKKNGYGTIQMEDLSGIKEVQQYPKYLQHWTYYDLQLKIQYKAKEAGIG FVKVTPKYTSQRCSHCGNIDEANRPKQDVFRCTVCGYERNADYNASQNLSIK GIDRIIDDQLKQMNKANPKKTENA |
| 7 CasM.293891 | MSGGAITKVMKYDLTYKDGYGNFKDMQEAVWKLIRDTRTILNETIKIAYHW DYLNEKSKRETGEHLDLLEETGYKRLDGYIYDDLKDRFPDFASSNLNAAIQT AWKKYKQSQKDVYIGKMTLPSYKSDQPLPINKQSIKIYDEEREHIVELNLFST KHKKEHGLASNVRFRINLHDNTQHAIYERVLSGEYTLGQCQLLYDRPKWFFI LTYSFKPAQNKLDPDKILGVDMGETCALYASTFGEQGSFVINGGEVSEYAKR EEARKRSLQKQAAVCGEGRIGHGTKTRVSSVYKEQERISNFRDTINHRYSKAL IEYAVKNGCGTIQMEDLSGIRQSTDFPKFLRHWTYYDLQQKIKTKAKETGIAV SMIDPRYTSQRCSRCGHIDKANRRKDQAHFHCLKCGYSCNADFNASQNISIRGI DKIIQKELGAKAKQTD |
| 8 CasM.294270 | MKEIAKVMKYQLIYLDGGGDFYELQQTLWDLQRQTREILNKTIQSMYLATAT NTAFEENALYHRFGAEYPMMAALNVNATLRTAKKRYTSTIKETLRGTMSLPS YKRDQPILLHNQTIHLALEDGQYSALFSVYSEKFQKAHEGVARPRFALMARD GTQRAILDRLLDGSYRLGQSQMTYEQKKWFLSLTYKFVPEVRELDKSKILGV DLGCVYAIYASSMQQKGIFKISGDEITEFEKRQAAMQNREPVSTLERVEQLEQ RRWQKQQQARYCGEGRVGHGTGTRVAPAYRDADKIARFRDTINHRYSKAL VEYAEKNGFGTIQMEDLSGIKEDTGFPKRLRHWTYFDLQTKIQYKAAERGIT VVKIDPQYTSQRCSRCGYIDKANRASQEKFLCQSCGFEANADYNASQNISVE KIDKLIAKDKKKLART |
| 9 CasM.294491 | MGQVTKVMRYQLIYQDGGGDFYTVQQELWELQRQTREILNKTIQTMYLADA NKEKFDNAAERTLNRRFCVDHPDMYTKTVTATLRKAKAKYNASQKEILAGR MSLPSYKRDQPILLNPQGFKIEEESDSFFAAIAVFSDKYKNKHPDVDVKRLRF RLVVKDGTQRAIIRRVISGEYKLGRSQLLYSKKKWFLNVTYSFEPAEKKVDP DKILGVDLGCVYAIYASSFGSPGVFKISGDEVSSFERKQAAIQNRSPKSTLERV EKIEERHKQKQQQARYCGEGRIGHGTKTRIAPVYQDEDKIARFRDTVNHRYS KALIDYAEKNGYGTIQMEDLSGIKSATGFPKRLKHWTYYDLQTKIEYKAEER GIKVVKIDPRYTSQRCSRCGYIDSGNRKSQAEFCCMACGFSCNADYNASQNIS IGGIAKIIADKREADAK |
| 10 CasM.295047 | YLDIREETGYKTLDGYIYNCLKGAYSEMASANLNAAVQKAWKKYKNSKTQ VLQGVMSLPSYKSDQPILIDKGNVKLSAEENNGRAVLTLFSRNYRDTRGLKG NVEFSVLLHDGTQKSIFRNLIDKTYALGQCQLVYERKKWFLLLTYSFTPAGH ALDPEKILGVDLGECYALYASSCYAPGILKIEGGEIAEYALRLEKRKRSLQQQ ARYCGEGRIGHGTKTRVGVVYKAEDRIASFRETINHRYSKELVDYAVSNGYG TIQMEDLSAIQKDLGFPKRLRHWTYYDLQMKITNKAKEHGIAVVKIDPRYTS QRCSKCGHIDPANRPRQEEFCCTACGYACNADYNASQNISIKGIEKIIQKMLS AKAD |
| 11 CasM.299588 | MAEKTIVKVMKFELRYIDGAGEFSEMQKHLWELQKQTREVLNKTIQMGYAL ECKRFAHHDKTGQWLDDKELTGSKYKAVADYINAELKEDYNIFYSDCRNST VRKAYKKFKDAKNKIFSGEMSLPSYRSNQPIIIHNRNVIIRGNAESALVGLKVF SDGFKALHGFPAAVNFKLCVKDGTQRAIIENVISEIYKISESQLIYDNKKWFLI LAYRFTQKKNDLNPDKILGVDLGVKFAVYASSIGEYGSFRIKGGEVTEFIKRL EKRRKKSLQNQATVCGDGRIGHGTKTRVADVYKARDKISNFQDTINHRYSRAI VDYARKNGYGTIQLEKLDNSIEKKGDYSPVLVHWTYYDLRTKMEYKAAEYG IKVIAVEPKYTSQRCSKCGYISSENRKTQESFECIKCGYKCNADFNASQNLSVR DIDRIIDEYLGANPELT |

TABLE 1-continued

Exemplary Amino Acid Sequences of Effector Proteins

| SEQ ID NO: Effector Protein Name | Effector Protein Amino Acid sequence |
|---|---|
| 12 CasM.277328 | VVNVAKGALSKVMKFELSYLDGCGDFQNMQKELWTLQRQTREILNRTIQIA YHWDYTDREHFKKTGQHLDVKSETGYKRLDGYIYDELKETVQNFASVNVN ATIQKAWAKYKSSKTDVLRGDMSLPSYKSDQPLVLHAQSIKLSEDKDGPVLQ VTLFSNAHKKACDYSNVRFAFRLHDATQRAIFKNVLSGEYGLGQSQIVYKRP KWFLYLTYNFSPEQHGLDPDKILGVDLGESIALYASSLGDYGSLRIEGGEVTA FAKQLEARKRSLQKQAAHCGEGRVGHGTRARVSDVYKAEDKIANFRNTVN HRYSKKLIEYAIQNRYGTIQMEDLSGIKQDTGFPKFLQHWTYYDLQQKIEAK AKENGINFIKVDPSYTSQRCSKCGNIDSDNRPSQAVFCCTKCGFRANADFNAS QNLSIPEIDKIIKKERGANTK |
| 13 CasM.297894 | MAKKGTNRKKMIVKVMKYELKYEKGCADFNEMQNELWKLQRQTREVMNR TVQLCYHWNYVQADYCKQHGCAHRDVKPCDVYETNATSLDGYIYQLFKDE YPNFLMANLIATLRKAHQKYDALLPDIQEGNSSIPSFKKDQPLIFSKEAIHLPE CLSDKRQITLFCFSKPYKSAHPTLDKITFAVRAHSASEKSIFDNIIINGKYALGTS QLVYEKKKWFFLLSYKFTPESVDVNPEKVLGVDLGVVNALCAGSVENPHDS LFIKGTEAIEQIRRLEARKRDLQKQARYPGDGRIGHGTKTRVSPVYQTRDAIA RMQDTLNHRWSRALIDFACKKGYGTIQMEDLSGIKAMESEKPYLKHWTYFD LQSKIIYKAEEKGIRVVKVNPKCTSRRCSACGYISKENRKNQAEFLCVNCGYH HNADYNAAQNLSIPQIDRLIEKQLKEQESEESEAGANPK |
| 14 CasM.291449 | MTERHDNESSKIKAEVSLLNSSVPDFEKKRHVKVLKLHILKPAGDMKWDELG ALLRDARYRVFRLANLAISEAYLDFHKWRSGGNEQPKLKISQLNRNLRSMLE DEVTGKQTKMIKSDRYSKSGALPDSIVSPLSMYKLGGLTSKSKWSEVLRGKS SLPTFKLNMAIPVRCDKPGDRRIERTKNGDAEVELRICLQPYPRVIIATGRNSL GDGQRAILDRLLDNTKYSEQGYRQRCFEIKEDQRSGKWHLFVTYDFPAIEPA KNLSRERIVGVDLGAACPLYAAINTGHARLGWKHFSPLAARVRALQNQTIRR RRQILRGGKVSLSEDSARSGHGRKRKLKPISKLEGKIDRAYTTLNHQLSATVI KFAKDNGAGVVQMEDLKGLRETLTGTFLGERWRYEELQRFIRYKADEAGIEI RLVNPQYTSRRCSECGHIHKDFTREFRDKSREGNKSVRFLCPDCGFTADPDYN AARNLASLDIAAIIERQLEIQGLRKHDP |
| 15 CasM.297599 | MKEKSKTLVKVARLRILKPAGDMKWSELGEMLRTVRYRVFRLANLAVSEAY LGFHMYRTNRATEFKAETIGKLSRRLREMLIEEGVDEKDLSRYSQTGAVPDT VAGALGQYKIRGITSPTKWRQVVRGQAALPTFRNDMAIPIRCDKQYQRRLEK TEAGEIEVELMICRKPYPRIVLGTADLGPGQRAILERLLQNTDNSADGYRQRL FEAKQDTQTKKWWLYVTYDFPRLKEGKLNQEIVVGVDLGFSIPLYVALNIGH ARLGRRHFQALGNRIRSLQRQVLARRRSIQRGGRVNISHSTARSGHGRKRKLL PTEKLRGRIEKSYSTLNHQLSASVIDFAKNHHAGTIQIEDLANLKEELAGTFIG ARWRYHQLQQFLKYKAEEEAGITLNQVNPRYTSRRCSECGFINIDFDRAFRDA GRTEGRVTKFLCPECGYEADPDYNAARNISILDIDKLIRVQCKKQGLTYDAH |
| 16 CasM.286588 | MPERPKTVNKVIWFQIHKPAGDMTWKELGNLLREARYRVFRLANLAVSEKY LSFHMWRTGQEYKSETIGKLNRRLREMLIEEGVEEESQKRFSATGALPDTVVS TLAKGKLAAITSKSKWKDVVNGKTSLPTFKLNMAIPVRCDKAEQRRLRRTES GDVELELMICKQPYPRVVLKTGKLKSGQRAILDRLVENNDNSKEGYSQRVFE IKQVENNDGSKEWRLYISYTFPKKAVEEANADVAVGVDIGFSVPLVAAVNNG LERLGYNDFRALNERIRSLQRQVLVRRRSMQSGGRDYVSTPTARSGHGRKRK LLPIQTLRKRWDNAYTTLNHQLSHAVVSFAENHGAATIQIENVKSLKDELRG TFLGQRWRYFELQQFLKYKADEVGIELREVNARYTSRRCSECGYINMAFTRQ ARDKGRVDGKPMEFVCPECGYKAHPDYNAARNIAMLDIEQKMQVQCKQQG ITYADDSEVL |
| 17 CasM.286910 | MTWPELGNMLRTVRYRVFRLANLAVSEAYLGFHMFRTKRAEEFKAETMGK LSRRLREMLIEEGVDEKDLSRYSQTGAVPDTVAGALSQYKIRGITSPTKWRQI VRGQVALPTFRNTMSIPVRCDKLYQRRLEQGDSGEVEVELMICRNPYPRVVL GTGDLNPGQQAILERLLQNTDNSADGYRQRLFEIKEDVQTRKWWLYVTYDF PKTTGKLNPEIVVGVDLGFSIPLYVALNSGHARLGYLHFKALGERIKSLQKQV MARRRAIQRGGRVSISHSTARTGHGVKRKLQPTEKLRGRIEKSYSTLNHQLSA SVIDFAKNHHAGVIQIEDLSGLKEQLTGTFIGARWRYHQLQQFLKYKAEEAGI TLKQINPRYTSRRCSECGFINMDFDRAFRDAGRTYGKVTKFLCPECGYEADP DYNAARNIATLDIEKLIRVQCEKHGLKFDAH |
| 18 CasM.292335 | VGKEGKRNVKVMKIRILKPCDGMTWNELGQLLRDARYRVFRLANLTVSEAY LNFHLWRTGRSQEFKKQTIGQLNRQLRNILQQEKYDDEKLNRYSKTGALPDT VCSALWQYKLMAVMKKSKWSEVIRGKSSLPTFRNDMAIPVRCDKPEQKRIE KTEQGQVEAALQVCVQPYPRVILGTHTLGDGQDAILKRLLDNQNQAIGGYRQ RSFEIKYDEQKRWWLFITYDFPATEVATDKTIAVGVDLGVSVPLVAAVNNGP ARLGRREFGGLGRRIRDLRNQTDARRRSIQRSGREGQSDDTARAGHGRKRKL LPIHILEGRLDKAYTTLNHQMSAAVIKFAAEQGAGIIQIENLAGLQDELRGTFI GGRWRYRQLQDFLKYKTQEMGIELRQVNPKYTSRRCSKCGFIHKDFDRDYR NRHSENGKPAQFVCPNPDCKYESDPDYNAARNLATLDIEEQIRVQCQKQGLE YDSKKDKNAL |

TABLE 1-continued

Exemplary Amino Acid Sequences of Effector Proteins

| SEQ ID NO: Effector Protein Name | Effector Protein Amino Acid sequence |
|---|---|
| 19 CasM.293576 | MKEKSKTLVKVARLRILKPAGDMTWSELGEMLRTVRYRVFRLANLAVSEAY LGFHMFRTQRAAEFKAETMGKLSRRLREMLIEEGVDEKELNCYSLTGAVPDT VAGALHQYKIRGITSPTKWRQVVRGQAALPTFRNDMSIPIRCDKPYQRRLEK TEAGEVEVELMICRKPYPRIVLGTADVGPGQEVILERLLQNKDNSSDGYRQRL FEAKQDRQTGKWWLYVTYDFPRPEEGELNPEIVVGVDLGFSVPLYVAINNGY ARLGRRHFQALGNRIRSLQRQVLARRRSIQRGGRVNISHDTARSGHGIKRKLL PTEKLRGRIEKSYSTLNHQLSASVIDFTKNHHAGTIQIEDLANLKEVLAGTFIG ARWRYHQLQQFLKYKADEAGITLKEVNPRYTSRRCSECGFIHKDFDRAFRDS GRTDGKVARFVCPECGYGPVDPDYNAAKNISTLDIEKHIRVQCKKQGLEYEV H |
| 20 CasM.294537 | MKEKAKTLVKVARLRILKPAGDMTWPELGNMLRTVRYRVFRLANLAVSEA YLGFHMFRTKRAAEEFKAETMGKLSRRLREMLIEEGVDEKDLSRYSQTGAVPD TVAGALSQYKIRGITSPTKWRQIVRGQVALPTFRNTMSIPVRCDKLYQRRLEQ GDSGEVEVELMICRNPYPRVVLGTGDLNPGQQAILERLLQNTDNSADGYRQR LFEIKEDVQTRKWWLYVTYDFPKTTGKLNPEIVVGVDLGFSIPLYVALNSGH ARLGYLHFKALGERIKSLQKQVMARRRAIQRGGRVSISHSTARTGHGVKRKL QPTEKLRGRIEKSYSTLNHQLSASVIDFAKNHHAGVIQIEDLSGLKEQLTGTFI GARWRYHQLQQFLKYKAEEAGITLKQINPRYTSRRCSECGFINMDFDRAFRD AGRTYGKVTKFLCPECGYEADPDYNAARNIATLDIEKLIRVQCEKHGLKFDA H |
| 21 CasM.298538 | MAKKAKTMFKVTNFRILKPAGDMTWKELGQLLRDARYRTFRMANLALSEA YLNFYLLKKGDLKEYKNVKIGQIAKRLRDMLIEEGVDEEVQNRFSPKVALPA YVYSALDQFKLRGLTSKSNWKKVLRGQASLPTFRLNMSVPIRCDKPEHRRLE KTENGNVEVDLMICRKPYPRVVLETLKLDGSSKAILDRLLENEDNSPGNYRQ RCFEVKQNPRSNDWWLYVTYEMPVDKDKKLDPKIVIGVDLGFSVPLYVAIN NGHARLGRRHFQALGKRIHNLQNQVLARRRSIQRGGQVNLSHSTSRSGHGRK RKLQPTEKLQQKINSAYSTLNHQLSSSVIDFANNHKAGTIQIEDLETLKEQLTG TYIGRQWRYYQLQQFIEYKAKENSITVKKINPKYTSRRCSMCGHIHADFDRTF RDRSSNKGFVTKFICPECNFEADPDYNAAKNISTLDIENKIKLQCKKQIDY |
| 22 CasM.19924 | MPKITRKIELLFDRSGLSEEECKEKWRFIYQINDNLYRVANRLVNQLYLADEI DDILRLSDQEYIALRKKLANKKLDEATRISLEEQMSQVMKRVNERRSAILQRP QQSFAYSVVTDSDTEGLTAKILDVLKQDVLSHYKADTKEVLKGEKSISNYKK GMPIPFAFNDSLRLYKEDGFFYLKWYNGIRFLLNFGRDASNNQLIVERCLGIS KDEISYKACSSSIQIKKKGNHSKIFLLLVVDVPVEQYAQKPNMVVGVDLGLN VPIYAASNSTLERKAIGSREAFLNQRGAFQRRFRALQRLQTTKGGRGRLHKLE PLERVREAERNWVRTQNHLFSREVINFAIDVGASTIQMEKLANFGRDAQGEV REDKKYVLRNWSYFELQNLIEYKAKRAGIKVKYINPAFTSQTCSECGQLGER DSIHFKCTNPDCPNCGKDIHADYNGARNIAKSKDYIK |
| 23 CasM.19952 | MPTITRKIELTLLTEGLSEEQRKEQWGLLYHINDNLYKAANNISSKLYLDDHV SSMVRMKHAEYLSLLKELARAEKQKTPDADAIAELRKKVAAAEKEMTDQEH AICKYATEMSTQSLSYRFATELETNIFAKILDCLKQGVFATFNSDARDVKRGE RAIRNYKKGMPIPFAWDKSLRIEKDNKDFYLRWYNGLRFLFNFGKDRSNNRL IVERCLKMDADYDGEYKLCNSSIQIAKREGKTKLFLLLVVKIPQEHVELNKKV VVGVDLGINVPAYVATNITEERKAIGDREHFLNSRMAFQRRYKSLQRLRGTA GGKGRAKKLEPLERLRKAEHNWVHTQNHLFSREVVDFAVKSHAATIHMEDL SGFGKDNDGNADERKEFVLRNWSYYELQNMIAYKAAKYGIKVEKIHPAYTS KTCSWCGQLGFREGVTFICENPECKQCGEKVHADYNAARNIANSKDIIKKNE |
| 24 CasM.274559 | MPTITRKIELTLCTDGLSEEQRKEQWGLLYHINDNLYKAANNISSKLYLDDHV SSMVRMKHAEYLSLLKELARAEKQKTPDADAIAELKKKVAATEKEMTDQEH AICKYATEMSTQSLSYRFSTEFETKIFAKILDCLKQGVFATFNSDAKDVKRGE RAIRNYKKGMPIPFAWTDSLRIKKDNKDFYLLWYNGLRFLFNFGKDRSNNRL IVERCLKMDADYDGEYKLCNSSIQIAKREGKVKLFLLLVVSIPKEHVELNKKV VVSVDLGINVPAYVATNITEERKAIGDREHFLNSRMAFQRRYKSLQRLKGTT GGKGRTKKLEPLERLRKAEHNWVHTQNHLFSREVVDFAVKTHAATIHMEDL SGFGKDNDGNADERKEFVLRNWSYYELQNMISYKAAKYGIKVEKIRPAYTS KTCSWCGQHGFREGVTFICENPACKQCGEKVHADYNAARNIANSKEIIKKNE |
| 25 CasM.286251 | MPTITRKIELTLCTEGLSDQERKDQWNLLYHINDNLYRAANNISSKLYLDDHV GSMVRLKHAEYLSLLRALEKAKKQKAPDEEVIAELSQQVATAEQEMDEQAK AICQYATEMSTQTLSYRFATELETNIFGQILTCLRQGVFSTFNSDARDVKRGE RSIRTYKKGMPIPFPWNDSLRIGFEDGEFYLRWYNGLRFRFDFGKDRSNNCLI VQRCMKMDKDYEGDYKLCNSSIQMVKREGKPKFFLLLVVNIPQERVELNKN |

TABLE 1-continued

Exemplary Amino Acid Sequences of Effector Proteins

| SEQ ID NO: Effector Protein Name | Effector Protein Amino Acid sequence |
|---|---|
| | IVVGVDLGINAPAYVATNTTPERKQIGDREHFLNERMAFQRRFKSLQRLKGT<br>TGGRGRAKKLEPLERLRKAEQNWVHTQNHLFSREVIDFAVKARAATIHMED<br>LSGFGKDNDGNADERKEFVLRNWSYYELQNMITYKAAKYGIKVEKIRPAYT<br>SKTCSWCGHQGFREGITFICENPECKKFGEKEHADYNAARNIANSKEIIKNNE<br>E |
| 26<br>CasM.288480 | MPTITRKIELTLLTEGLSEEQRKEQWGLLYHINDNLYKAANNISSKLYLDDHV<br>STMVRMKHAEYLSLLRELARAEKQKKPDVDAIAELREKVTAAEKEMSDQER<br>AICTYATEMSTQSLSYRFATEIETNIFAKILDCLKQGVFATFNSDARDVKRGER<br>AIRNYKKGMPIPFAWDKSLRIEKDNKDFYLRWYNGLRFLFNFGKDRSNNRLI<br>VERCLKMDADYDGEYKLCNSSIQIVKREGKVKLFLLLVVSIPQEHVELNKKIV<br>VGVDLGINVPAYVATNITEERKAIGDREHFLNSRMAFQRRYKSLQRLKGTAG<br>GKGRTKKLEPLERLRKAEHNWVHTQNHLFSREVVDFAVKSHAATIHMEDLS<br>GFGKDNDGNADERKEFVLRNWSYYELQNMIAYKAAKYGIKVERIRPAYTSK<br>TCSWCGQLGFREGVTFICENPECKQCGEKVHADYNAARNIANSKDIIKKNE |
| 27<br>CasM.288668 | MPTMTRKIELKLCTEGLSDEERKAQLGLLYHINDNLYKAANNISSKLYLDDH<br>VSSMVRLKHAEYLSLLNEFEKAKKKGDEEQIVELSLRVAAAEKELTDQELAI<br>CKYATEMSTDTLAYRFANEIEINVFGQILACLKQGIHSTFKKDAADVKRGERA<br>IRNFKKGMPIPFPWSKSIRIENEGSDFYLRWYNGLRFRFDFGKDRSNNRLIVSR<br>CLNLDPDFEDEYKLSNSSLQMVKRDGRPKLFLLLVVNIPQENVELNKKIVVG<br>VDLGINSPAYVATNITMERQRIGSRDTFLNARMAIQRRFQSLQLQNTAGGR<br>GRKKKLEPLERLKETERNWVRTQNHLFSRDVVQFAVKTRAATIHMEDLSGF<br>GKDDDGNADEKKEFVLRNWSYYELQTMIKYKAAKYGIKVEKIRPAYTSRTC<br>SWCGHEGDRKGETFICENPECEKYGKKENADYNAARNIANSTDIIK |
| 28<br>CasM.289206 | MPTITRKIELTLCTEGLSDEQRKEQWGLLYHINDNLYKAANNISSKLYLDEHV<br>SSMVRMKHAEYLSLLKELARAEKQQTPDEGLIAELSRKLSAAEKEMADQEL<br>AICKYATEMSTQTLSYNFAKEIETNIFGQILTCLRQGVYATFNSDAKDVKRGE<br>RAIRNYKKGMPIPFPWNNSLKIESDSGEFYLRWYNGLRFLLTFGKDRSNNRMI<br>VNRCMKMDEDFEGEYKLCNSSIQLAKRDGKPKLFLLLVVNIPQEHVKLNKKI<br>VVGVDLGVNVPAYVATNITEERKAIGDREHFLNTRMAFQRRYKSLQRLKGT<br>AGGKGRTKKLEPLERLRDAERNWVHTQNHLFSREVVNFAVQARAATIHMED<br>LSGFGKDKDGNADEKKEFVLRNWSFYELQNMIAYKSAKYGIKVVKIRPAYTS<br>KTCSWCGQQGDRKSTTFICENPKCKHYGESIHADYNAARNIANSNDIVKENE |
| 29<br>CasM.290598 | MPKITRKIEMTLCTEGLSDEQRKEQWGLLYHINDNLYKAANNISTKLYLDEH<br>VSSMVRMKHADYLSLLKELAKAEKKSPDEDLIAELREKLAAAEQEMTDQEL<br>AICKYATEMSTQTLAYKFATEIEINVFGQILACLKQAAQSNFKSDAKDVKRGE<br>RAIRNYKKGMPIPFPWNDNIRIDADGDEFYLRWYNGLRFHLTFGKDKSNNRM<br>IVKRCLKMDKDFEGEYKLCNSSIQMVKRDGKPKLFLLLVVNIPQEHVELNKN<br>VVVGVDLGVNVPAYVATNITEEREHFLNTRMQIQRRYKSLQRLKAT<br>AGGKGRTKKLEPLERLRKAEHNWVHTQNHLFSREVVNFAVQTHAATIHMED<br>LSGFGKDDDGNADEQKEFVLRNWSFYELQNMIAYKAAKYGIKVEKVKPAYT<br>SKTCSWCGQLGFRQGVTFICENPACKQCGEKVHADYNAARNIANSKDIIKKN<br>E |
| 30<br>CasM.290816 | MPTITRKIELHLCTDGLTDEQQKAQRLLLYHINDNLYKAANNVSSKLYLDEH<br>VSSMVRLKHDEYLSLSRELARAEKKHDDELTTELRGKLAAAEREMTDQELAI<br>CKYATEMSTQSLSYRLVTELETKIFAKILDCLKQGVYATFNSDARDVKRGER<br>AIRNYKKGMPIPFAWNDSVRIEYDEKEKDFYLRWYNDIRFKFHFGRDSNNR<br>LIVSRCLKLDKDYEGDYQLCNSSIQIVKRDGSTKFFLLLVVKIPQEHVELNKRI<br>VVGVDLGINYPAYVATNCTEERMYIGDREHFLNTRMQFQRRYKSLQKLKGT<br>AGGKGRSKKLEPLERLRNAERNWVHTQNHLFSLKVVNFAVQTHAATIHLED<br>LSGFGKDDDGNADERKEFVLRNWSYYELQSMIEYKAKKYGIKVEKIRPAYTS<br>QTCSWCGQRGFRQGVTFICENPECKKCGEKENADYNAARNIANSKDVIKDK<br>NE |
| 31<br>CasM.295071 | TPFVLYFQNYSLSLRQHITLYSMPTITRKIELTLCTEGLSDQERKDQWNLLYHI<br>NDNLYRAANNISSKLYLDDHVGSMVRLKHAEYLSLLRAMEKAKKQKAPDEE<br>VIAELSQQVAAAEQEMDEQAKAICQYATEMSTQTLSYRFATELETNIFGQILT<br>CLRQGVFSTFNSDARDVKRGERSIRTYKKGMPIPFPWNDSLRIGFEDGEFYLR<br>WYNGLRFRFDFGKDRSNNRLIVQRCMKMDKDYEGDYKLCNSSIQMVKREG<br>KPKFFLLLVVNIPQERVELNKNIVVGVDLGINAPAYVATNTTPERKQIGDREH<br>FLNERMAFQRRFKSLQRLKGTTGGRGRAKKLEPLERLRKAEQNWVHTQNHL<br>FSREVIDFAVKARAATIHMEDLSGFGKDRDGNADERKEFVLRNWSYYELQN<br>MITYKAAKYGIKVEKIRPAYTSKTCSWCGHQGFREGITFICENPECKKFGEKE<br>HADYNAARNIANSKEIIKNNEE |

TABLE 1-continued

Exemplary Amino Acid Sequences of Effector Proteins

| SEQ ID NO: Effector Protein Name | Effector Protein Amino Acid sequence |
|---|---|
| 32 CasM.295231 | MPTITRKIELHLCTEELSDEQQKAQRLLLYHINDNLYKAANNVSSKLYLDEHV SSMVRLKHDEYLSLLRELARAEKKADDELATQLREKLVAAEREMTDQELAIC KYATEMSTQSLSYRFVTELETKIFAKILDCLKQGVYATFNSDSRDVKRGERAI RNYKKGMPIPFAWDKSVRIEYEEKEKDFFLRWYNDIRFKFHFGRDRSNNRLI VSRCMKLDKDYEGDYQLCNSSIQIVKRDGSTKYFLLLVVKIPQEHVELNKKIV VGVDLGINYPAFAATNCTEERMSIGDREHFLNTRMQFQRRFKSLQRLKGTTG GKGRNKKLEPLERLRKAEHNWVHTQNHLFSLKVVNFAVQAHAATIHLEDLS GFGKDDDGNADERKEFVLRNWSYYELQNMIKYKAKKFGIQVEKIRPAYTSQ TCSWCGQRGFRQGITFICENPECKKCGEKENADYNAARNIANSKDIIKDKDE |
| 33 CasM.292139 | MPIITRKIELHISKEGLSAEDYKAQWQYLRQINDNLYMAANRVSSHCFLNDEY KYRLCLQIPDYIDIEKQLKDSKRARLSKEELGQLKKRKKELENTVKGRFQDEF EKNSLYTIISNEFGEIIPGQILTCLRQCVQSKYNRAKEELEKGERAISTYKKGMP IPFPINKSIRLQKQGEDFVLKWYNKIVFKLHFGRDRSNNRVIVERLIQSALNDK QKGEDYVMNNSSIQLVEKDKMTKIFLLLSMDIPTQKRKLDSELVLGVDLGLN FPLYYATNQSANIHDHIGDKDIFLKERMVFQRRFKELQRLQCTQGGRGRKKK LEPLEKLRDKERNWVRTKNHIFSREVIKVALHLGAGTIHLENLHNFGKDGNG ELKNSKKFVFRNWSYFELQSMIEYKAKMEGITVKYVNPAYTSQTCSVCGMIG ERKEQAVFRCMNSSCLEYGKEVNADFNAARNIAKAKM |
| 34 CasM.279423 | MPTITRKIELTLCTDGLSDDLRKDQWQLLYHINDNLYKAANNISSKLYLDEHV ASMVRLKHAEYLGLIKELAKARKRADDEAVRDLCSKLAVAEQEMNEQAKAI CDYATEMSTQTLSYNFAKEIETNIFGQILTCLRQGVLLNFNSDARDVKRGERA IRNYKKGMPIPFPWNDTIKIVSEGDEFYLRWFSGLRFHLNFGKDRSNNRMIVR RCLKMEQDFDEEYKISNSSIQVAKRDGKQKLFLLLVVQIPQEQVVLNKKIVV GVDLGVNVPAYVATNITEERKAIGDREHFLNTRMQFQRRYKSLQRLKTTEGG RGRAKKLEPLERLRKAEHNWVHTQNHLFSREVVNFALQTQAATINMEDLSG FGKDNDGNADECKEFVLRNWSYYELQNMIVYKASKYGIRVQKIRPAYTSKT CSWCGHMGFREGVTFICENPDCKQFGEKVHADYNAARNIANSKEIIKNDE |
| 35 CasM.20054 | MSKTVTKTVKIALICEHTNKYGEKVDYKDINKLLWKLQKQTRELKNKTIQLC WEYNNFSCDYYKEHHEYPNMEDILKYKRINGFVENKLKTVNDLYSSNCSTTI LSTCNEFQNYRSEFLKGTRSINSYKSDQPLDLHKGAIKLEHDGKDFYVSLKLL KRSAFNAMEFKGSDIRFKLNVKDKDKSTLKILESCYDKIYSISASKMTYDRKA GKWFLLLAYSFTPAKTENLDPEKILGVDLGIKIPICASVYGDLDRLTIEGGKIEE FRRRVEARKRSLQKQGKQCGDGRIGHGTKKRIKPITDIGDKIARFRDTENHIY SRYLIEYAVKKGCGTIQMEKLEGITREKDIFLKNWTYFDLQKKIEYKAKEKGI KVVYIEPAYTSKRCSSCGFIDTDNRLDQAHFKCLKCGFNENADYNASQNIGIK NIDKIIKEEHKSASDKLTSE |
| 36 CasM.282673 | VIILTKVVKLYLISEQINKEGQKIDYQRINSILWDLQKQTRDIKNRTVQLCWE WMNFSSDYCKTQEEYPKERDILGYTLEGYVVDYFKTGYDLYTGNISTSSREV CSSFKNVKKEILKGERSILSYKANQPLDLHKKAISLEYDNFNFFVKLKLLNRT GKKKYDITEDINFKIQVNDKSTRTILERCYDKEYKISGSKLIYEKKKKLWRLN LCYSFENSQVETLEKDKILGIDLGIVYPLMASIYGEYDRFSIKGGEIEEFRRRTE ARKRSILQQTKYCGDGRIGHGRNKRTQPAYKINDKIARFRDTANHKYSRALIE YAVKKNCGIIQMENLTGISDNTDCFLKDWSYYDLQTKIENKAKEMGIKVVYI KAQYTSQRCSRCGYIDVNNRIRQALFKCQNCGYETNADYNASQNIGMYDIEN IIEETLKIQSANVKQS |
| 37 CasM.282952 | MTKVTKVYLISEQIDKDGNKIDFKKISELLWNLQMQTRDIKNKCVQLCWEWL NFSSDYYKKSEEYPKEKDTLGYTLSGFVYDRIKNGSDLYSSNLSTSSRDTCTA FSNYKKEMLKGERSVLSFKANQPLDIHNKAIKLSYENGNFFVALKMLNRAGK EKYGIKDDLRFRMQVRDKSVRTILERLMNDEYKVSASKLMYDKKKKLWKL NLCYSFDNHVISTLDTEKIMGVDLGVVYPIMASVNGDYARFSIKGGEIEAFRS RVEARRRSLLNQSRYCGDGRIGHGRKKRTEPATQIADKIARFRDTTNHKYSR ALIDYAIKNGCGTIQMEKLTGITSSAEHFLKEWSYFDLQTKIESKAKEAGIKVV YINPKFTSQRCNKCGYIHTDNRPVQARFCCQKCGYEENADYNASQNIGTKHI DVIIEETLKMQCEPETPTE |
| 38 CasM.283262 | MNKVVKLALICEQSDKDNSPVDYKKINEILWELQKQTREIKNKAIQYCWEYN NFSSDYYKKFNEYPKEKDILSYTLVGFVNDKFKTGNDLYSGNCSTTVRNACT EFKNSKKELIKGSRSIINYRSNQPLDIHNKCIRIEFENNCFYTYLKLLNRPAFKK YNFANTEIKFKILVRDNSTKTILERCISNEYEIAASKLLYDQKKKCWFLNLVYA FEIKSNNSLDPNKILGVDLGIHYPICASVYGSLDRFTIDGGEIDEFRRRVESRKIS MLKQGKNCGDGRIGHGIKARNKPVYNIEDKIARFRDTANHKYSRALIEYAVK HTCGTIQMEDLTGITDIANRFLKNWSYYDLQTKIEYKAKEAGINIVYIDPKNTS RRCSKCGYIDKENRETQSRFICLKCGFKENADYNASQNIGIKDIDKLIKEDVH |

TABLE 1-continued

Exemplary Amino Acid Sequences of Effector Proteins

| SEQ ID NO: Effector Protein Name | Effector Protein Amino Acid sequence |
|---|---|
| 39 CasM.284833 | VTLLVKVVKIYLISEQFDKAGNQIDYKEVNKILWELQKQTREAKNKTVQLLW EWNNFSSDYVKASGIYPKAKDIFGYSSVHGQANKELRTKLALNSSNLSTTTM DVCKIFNTYKKEVWEGKRSVPSYKSDQPLDLHKESIKLIYENNEFYVRLALLK KAEFAKYGFKDGFRFKMQVKDNSTKTILERCFDEVYKINASKLLYDQKKKK WKLNLSYSFDNKNISELDKEKILGVDVGVNCPLVASVFGDRDRFIIKGGEIEK FRKSVEARRRSMLEQTKYCGDGRIGHGRKKRTEPALNIGDKIARFRDTTNHK YSRALIEYAVKKGCGTIQMEKLTGITSKSDRFLKDWTYYDLQTKIENKAKEV GINVVYIAPKYTSQRCSKCGYIHKDNRPNQAKFRCLECDFESNADYNASQNIG IKNIDKIIEKDLQKQESEVQVNENK |
| 40 CasM.287700 | MNKVVKLALICEQSDKNNSPVDYKKVNEILWELQKQTREIKNKTIQYCWEY YNFSSDYYKKFNKYPKEKDILSYTLWGFINDKFKTGNDLYSGNCSATTKKVI KEFKNSKKELIRGSRSIINYKSNQPLNIHNKCIHLQFKNNNFYVSINLLNRRSFK KYNFANTAIKFKILVRDNSTKAILERCISNEYKISESQLIYNKKKKCWFLNLSY AFEIKSNNSLDPNKILGVDLGIHYPICASVYGSLDRFTIDGGEIDEFRRRVESRK ISMLKQGKNCGDGRIGHGIKARNKPVYNIEDKIARFRDTANHKYSRALIEYAV KNNCGTIQMEDLTGITDNANRFLKNWSYYDLQTKIEYKAKEASINVVYINPE NTSRRCSKCGYIDKENRKTQSSFICLKCGFKENADYNASQNISIKDIDKLIKED VH |
| 41 CasM.291507 | VTLLVKVVKIHLISEQFDKAGNRIDYEEVNKILWELQKQTREAKNKTVQLLW EWNNFSSDYVKASGIYPKAKDIFGYSSVHGQANKELRTKLALNSSNLSTTTM DVCKNFNTYKKEVWKGKRSVPSYKSDQPLDLHKDSIKLIYENNQFYVRLALL KKAEFAKYGFKDGFHFKMQVKDNSTKTILERCFDEVYKINASKLLYDQKKK KWKLNLSYSFDNKNISELDKEKILGVDVGVSYPLVASVFGDRDRFKIKGGEIE KFRKSVEARRRSMLEQTKYCGDGRIGHGRKKRTEPALNIGDKIARFRDTTNH KYSRALIEYAVKKGCGTIQMEKLTGITSKADRFLKDWTYYDLQTKIENKAKE VGINVVYIAPKYTSQRCSKCGYIHKDNRPNQAKFRCLECDFESNADYNASQNI GIKNIDKIIEKDLQKQESEVQVNENK |
| 42 CasM.293410 | LIWKDALGGIILTKIVKLYLISEQIDKDGNRVDYKEINSILWNLQKQTRDIKNK TVQLCWEWMNFSSDYYKKNELYPNEKEILNLTLRGYAYDHFKQGYDLYSSN ISVLTEAVCGAFKNAKKEMLNGEKSVLSYKAEQPLDIHKKCIKLEYDKNFYV KLKMLNKAGKKKYGIEDDLNFKIQVEDKSTRTILERCIDGEYVVSGSKLIYDK KKKLWKLNLCYSFKANEIESLDKNKILGIDLGIACPLMASVNGEFDRFSIKGG EIETFRKRIEARKRSVLHQTKYCGDGRIGHGRNKRTEPAYKINDKIARFRDTA NHKYSRALIDYAIRKNCGMIQMENLTGISDKKEHFLKEWSYYDLQTKIENKA KEKGIKIVYINPEYTSQRCSKCGYIDANNRELRAVFKCQKCGFEADADYNAS QNIGIKNIEDIIENTLKISSANEKQTKNT |
| 43 CasM.295105 | VFYSTFLCYILTKYIDFSANECYNINTSSEVKQLMNKVVKLALICEQSDKNSP VDYKKINEILWELQKQTREIKNKAIQYCWEYNNFSSDYYKKFNEYPKEKDILS YTLVGFVNDKFKTGNDLYSGNCSTTVRNACTEFKNSKKELIKGSRSIINYRSN QPLDIHNKCIRIEFENNCFYTYLKLLNRPAFKKYNFANTEIKFKILVRDNSTKTI LERCISNEYEIAASKLLYDQKKKCWFLNLVYAFEIKSNNSLDPNKILGVDLGI HYPICASVYGSLDRFTIDGGEIDEFRRRVESRKISMLKQGKNCGDGRIGHGIKA RNKPVYNIEDKIARFRDTANHKYSRALIEYAVKHTCGTIQMEDLTGITDIANR FLKNWSYYDLQTKIEYKAKEAGINIVYIDPKNTSRRCSKCGYIDKENRETQSR FICLKCGFKENADYNASQNIGIKDIDKLIKEDVH |
| 44 CasM.295187 | LISEQIDKDGNRVDYKEINSILWNLQKQTRDIKNKTVQLCWEWMNFSSDYYK KNELYPNEKEILNLTLRGYAYDHFKQGYDLYSSNISVLTEAVCGAFKNAKKE MLNGEKSVLSYKAEQPLDIHKKCIKLEYDKNFYVKLKMLNKAGKKKYGIED DLNFKIQVEDKSTRTILERCIDGEYVVSGSKLIYDKKKKLWKLNLCYSFKANE IESLDKNKILGIDLGIACPLMASVNGEFDRFSIKGGEIETFRKRIEARKRSVLHQ TKYCGDGRIGHGRNKRTEPAYKINDKIARFRDTANHKYSRALIDYAIRKNCG MIQMENLTGISDNKEHFLKEWSYYDLQTKIENKAKEKGIKIVYINPEYTSQRC SKCGYIDANNRELRAVFKCQNCGFEADADYNASQNIGIKNIEDIIENTLKISSA NEKQTKNT |
| 45 CasM.295929 | LVKVVKIYLISEQVDEQGKDVDYNTICGVLWDLQWETREIKNKTVQLCWEW SGFSSDYYKKYGEYPKEKNLLDYTMGGFVYDKLSKYHLYTANLSTTSQNT CGIFRTYKVDFVKGNRSVLSFKADQPLDVHKKSISIDRIDDNYFVKLKLLNKS GIQKYGIRDDFHFRMLVKDNSTKTILERCVGGDYKAAASKIIYDKKKKMWCL NLSYEFDVNTAKDLNKNRILGIDIGIVYPVVASVNGELDRFVIQGGEIETFRRR VENRKKSLLKQTKYCGDGRIGHGRNKRTEPVDIISDQIARFRNTANHKYSRA VIDYAVRKQCGTIQMENLKGITDKSDRFLKNWSYYDLQQKIEYKAKEKGINV VFINPKYTSQRCSRCGYIDSANRPKLPNQSKFLCIKCGFTENADYNASQNIALY NIEKLIDAEA |

TABLE 1-continued

Exemplary Amino Acid Sequences of Effector Proteins

| SEQ ID NO: Effector Protein Name | Effector Protein Amino Acid sequence |
|---|---|
| 202 CasM.19498 | LHETEKSLKFAEKYIAMPTITRKIELTLCTEGLSDEQRKEQWGLLYHINDNLY KAANNISSKLYLDEHVSSMVRMKHAEYLSLQKELARAEKQKVDDAIIVELTR KLAVAEKEMTDQELAICKYATEMSTNTLAYNFAKEIETKIFGQILACLENNAH ALFVDDSPNVRRGERAIRNYKKGMPIPFPWNRSIKIEADGGEFYLRWYNGLR FLLTFGKDRSNNRLIVKRCMKMDEVFEGEYKLCNSSIQLAKRDGKPKLFLLL VVNIPQEHVELNKNIVVGVDLGVNVPAYVATNITEERKAIGDREHFLNTRMT FQKRYKSLQRLKGTAGGKGRTKKLEPLERLRDAERNWVHTQNHLFSREVVN FAVQARAATINIEDLSGFGKDNDGNADEKKEFVLRNWSYYELQNMITYKAS KYGIKVEKIRPDYTSKTCSWCGQQGFREGVTFICENPECKQHGEKIHADYNA ARNIANSKDIIKKNE |
| 203 CasM.19548 | MAETKRLQKVAKFQIVKPVNMSWDELGRMLRDVRYRLSRLANMAVSETYQ NLHQRYRLKNQDAPKSLKIGQLSRNLRKILREEGVEEENLSKYSKTCVLPDTI TGAFSRYKLSSIDWRKVLTGKISVPNYKTNLSIPIRCDKPHQRRLELTETGEIE ADLMICNKPYPRVLLSTRTISDGQRTVLERLVSNKTNFLPGYRHRFFEVKEKK GKWELSVTYDFPKAEATRLHPDIIVGVDLGWSVPLYAAINNGYARIGYRKFE PLAKRIKHLQKQIKGRRFSTQKGGVKDLAQPTARAGHGRKRILKPIEKLEYKI DNAYTTLNHQLSHCVVEFAKNNGAGLIQIENLEGLKDDLSGTFIGQNWRYNQ LQNFIKYKADEAGIKVHPVNPCYTSRRCSHCGFIHISFDREYRDKNRKNGKAT MFECPKGCKPLNADYNAAKNLATFDIEEKIRLQCKQQSIEYKELPKD |
| 204 CasM.19910 | MPGTEKRLQKVATFEIVKPVNMSWPEFGKMLRDVRYRYWRLANMAVCENY MRFYQWRTQQTDANDRYKVKTLNRILRKMLIEEKNADEKELSRYSRDGAVS GYICGAFEKTKLSAVKSSSKWKKVIAGKESLPLFKKDLAIPINCSDHQPRLIER TQSGEYEVDLRICQQPYPRVLLSTAKISDGQKAILERLVSNETNSLPGYRHRFF EIKEKRNKWYLSVSYDFPKIDATRLHPNIIVGVDLGWSVPLYAAISNGYARIG YRKLKALGDRIKALQRQTIARRRSIQRTGEQDLSAPTARSGHGRKRILHPIEKL EGKIDNAYKTLNHQLSHCVIEFAKNHGAGLIQVENLKGLAEELSGTFIGQNW RYNQLQEFIKYKAKEAGIEVKEVNPCYTSRRCSECGFIHKEFTFEYRQANKKT DKATMFECPKCGYKAIADYNAARNLANPDIAEKIRLQCKEQGIEYKELPKD |
| 205 CasM.19948 | MPTITRKIELHFCTEGLSDEKQEQRQLLYHINDNLYKAANNISSKLYLDEHV SSMVRLKHADYLSLQRELARAEKQKTPDDELITELSRKLSAAEKEMTDQELA ICKYATEMATSTLAYNFAKEMETEIFGQILACLENNAHAVFVDDSLSVKRGE RAIRNYKKGMPIPFPWNKNIKIETKDCEFYLRWYNGIRFRLHFGKDRSNNRLI VQRCLKLDDNFESEYKLCNSSIQLDKRDGKTKLFLLLVVNIPQEHVELNKNIV VGVDLGLNYPAYVATNSTEERKYIGDRDHFLKIRMQFQSRYKSLQRLKGTAG GKGRAKKLEPLERLRKAERNWVHTQNHLFSRDVVNFAVQTHAATIHMEDLS GFGKDNDGNADEKKEFVLRNWSYYELQSMIEYKAAKYGIKVEKIRPAYTSK TCSWCGQQGDRKSTTFICENPECKHYGESIHADYNAARNIANSKDIVKKNE |
| 206 CasM.265291 | MSKITRKIEIIPDIDGITHEESNKKCYNTFYKFDRKLYKVANLLVSQLYGLDNL LSLMRLQNDEYVKCQSKLSFKSITDATKEEIKKRMQEIDAELVSMKNDIAPKH PQTYSYRAVTSSEYAKDIPSDILNNLKQDVYQHFNENKKEQIRGERSLATYKK GMPIPFSFEKRHVIICDGDNYYLPWFEDTRFRLNFGRDRSNNRAIIDNCIKTKK YKLCAAAKIQLKERKLFLLITVDIPKAESVPVKGKVMGVDLGVINPAYVAVN DGPERSRIGNGEAFQKQRDVFRRRFRELQRSQLTQGGHGRKHKTKATEILRG KERNWVQTENHRISREIVNLASRWKVETIQMESLKGFGKNQEGEVEYNHKRL LGRWSYFELQKDIEYKAAMAGIAVQYVNPAYTSQTCHVCGQRGNRIERDTFI CTNPECTCYNQAQDADMNAAINIAKSKDVIK |
| 207 CasM.270012 | MPTITRKIELTLCTDGLSDEERKAQWGLLYHINDNLYKAANNISSKLYLDEHV SSMVRLKHAEYLSLQKELAKAERQKMPDVDVIEELRERLSAAEQEMSDQEL AICKYATEMSTNTLAYRFATEIETNIFGQILARLENNAQAVFLTDAPDVKRGE RAIRNYKKGMPIPFPWNNSIKIECEGGEFYLRWYSGLRFHFNFGKDRSGNRLI VQRCLKLDKEYDGEYKLCNSSIQMVKRDGSTKFFLLMVVNIPQEYVELNKHI VVGVDLGINVPAYVATNITPERKAIGDREHFLNTRMAFQRRYKSLQRLKTTA GGKGRTKKLEPLERLRQAEHNWVHTQNHLFSREVVNFALQTHAATIHLEDLS GFGKDSDGNADERKEFVLRNWSYYELQNMITYKAAKYGIRVEKIRPAFTSRT CSCCGHEGFREGVTFICENPECQQFGEKVHADYNAARNIANSKDIIKKNE |
| 208 CasM.272451 | MPTITRKIELTLCTEGLSEEQRKEQWGLLYHINDNLYKAANNISSKLYLDDHV SSMVRMKHAEYLSLLKELARAEKQKTPDADAIAELRKKVAAAEKEMTDQEH AICKYATEMSTETLAYKFATEIETNVFGQILACLKQAAQSNFKNDAKDVKRG ERAIRNYKKGMPIPFPPWNDSLRIEKDNKDFYLRWYNGLRFLFNFGKDRSNNR LIVERCLKMDADYDGEYKLCNSSIQIAKREGKVKLFLLLVVSIPQEHVELNKK VVVGVDLGINVPAYVATNITEERKAIGDREHFLNTRMAFQRRYKSLQRLKGT AGGKGRTKKLEPLERLRKAEHNWVHTQNHLFSREVVDFAVKTHAATIHMED LSGFGKDNDGNADERKEFVLRNWSFYELQNMITYKAAKYGIKVEKIRPAYTS KTCSCCGRQGFRSGVTFICENPECKQYGEKVHADYNAARNIANSKEIIKKNE |

TABLE 1-continued

Exemplary Amino Acid Sequences of Effector Proteins

| SEQ ID NO: Effector Protein Name | Effector Protein Amino Acid sequence |
|---|---|
| 209 CasM.274429 | MKNNVEEKRPDKEKRLTKVATFQIVKPVNMSWSEFGKMLRDVRYRLSRLAN MAVSEAYQNLHQRYRLKNQNAPKSVKIGQISRDLRKILLEEGLEEENLSKYS KMCVLPDTITGAFSRYKLSTIDWRKVLTGKISIPNYKANLSIPIRCDKPQQRRL ERTETGEIEVDLMICNKPYPRVLLSTRTISDGQRSVLERLVLNNANSLPGYRH RIFEIKEKRNEWYLSVTYDFPKAETTKLHSDIIVGVDLGWSVPLYAAINNGYA RIGYKQLKPLGDSIKALQRQTIARRRSIQRGGTQDLAAPTARSGHGIKRILQPIE KLEGKIDNAYKTLNHQLSHCVIEFAKNHGAGVIQIENLKGLAEELSGTFIGQN WRYYQLQEFIKYKAKEAGIIVKEVNPFYTSRRCSECGYIHKDFTFEYRQANRK NGKSTMFECPKKEEKGCKPLNADYNAARNLATSDIEDKIRLQCKEQGIEYKEI KEK |
| 210 CasM.277378 | VTLLVKVVKIHLISEQFDKAGNRIDYKEVNKILWELQKQTREAKNKTVQLLW EWNNFSSDYVKASGIYPKAKDIFGYSSVHGQANKELRTKLILNSSNLSTTTMD VCKIFNTYKKEVWEGKRSVPSYKSDQPLDLHNDSIKLIYENKEFYVRLGLLNR AGFAKYGFKDGFRFKMQVKDNSTKTILERCFDGIYTIVASKLLYDQKKNRW KLNLSYSFDNKNISELDKEKILGVDVGVSCPLVASVFGDRDRFIIKGGEIEKFR KSVEARRRSMLEQTKYCGDGRIGHGRKKRTEPALNIGDKIARFRDTTNHKYS RALIEYAVKKGCGTIQMEKLTGITSKADRFLKDWTYYDLQTKIENKAKEVGI NVVYIAPKYTSQRCSKCGYIHKDNRPNQAKFRCLKCDFESNADYNASQNIGI KNIDKTIKKERKKQKSEAQVNEK |
| 211 CasM.280852 | MAGKKKDKDVINKTLSVRIIRPRYSDDIEKEISDEKAKRKQDGKTGELDRAFF SELKSRNPDIITNDELFPLFTEIQKNLTEIYNKSISLLYMKLIVEEEGGSTASALS AGPYKECKARFNSYISLGLRQKIQSNFRRKELKGFQVSLPTAKSDRFPIPFCHQ VENGKGGFKVYETGDDFIFEVPLIKYTATNKKSTSGKNYTKVQLNNPPVPMN VPLLLSTMRRRQTKKGMQWNKDEGTNAELRRVMSGEYKVSYAEIIRRTRFG KHDDWFVNFSIKFKNKTDELNQNVRGGIDIGVSNPLVCAVTNGLDRYIVANN DIMAFNERAMARRRTLLRKNRFKRSGHGAKNKLEPITVLTEKNERFRKSILQR WAREVAEFFKRTSASVVNMEDLSGITEREDFFSTKLRTTWNYRLMQTTIENK LKEYGIAVNYISPKYTSQTCHSCGKRNDYFTFSYRSENNYPPFECKECNKVKC NADFNAAKNIALKVVL |
| 212 CasM.281050 | MPDTDKGKRLTKVATFQIVKPVNMSWNEFGKMLHDVRYRYWRLANMAVC ENYMRFYRWRTQQTDTNDHYKVKIINGILRKMLIEEKNADEKELSRYSRDGA VSGYVYGAFTQTKLSAITSKSKWGEVIKGKSALPLFKRDTSIPIMCTDKKPSMI EKTASGEYEVDLRICLKDKQLRPNGYPSVLLSTTKISDGQKAVLERLVSNKTN SLPGYRHRFFEVKEKRGDWYLSVSYDFPQAEATRLHPDIIVGVDLGWSVPLY AAINNGYARIGWRKLEPLAKSIKHLQKQTIVRRRSFQKGGKKDLAASTARTG HGIKRILQPIEKLEGKIDNAYKTLNHQLSHCIIEFAKNHGAGVIQIENLKGLAEE LSGTFIGQNWRYHQLQEFIKYKAEEEAGIAVKEVNPRYTSRRCSKCGYIHIGFD REYRDKNRKNGKSTMFECPECSKRIKDYKPLNADYNAAKNLATADIEEKIRL QCKEQGIEYKELPKD |
| 213 CasM.285333 | MPTITRKIKLELCTKGLSEEERKAQWNLLYHINDNLYRSANNISSKLYLDEHV SSLVWLKHKEHQTLKADLAKAKKQKIQDEKTIAELESRLKSCESEMSDQELAI CKYTDEMSSKTLSYKFATELELNIYAQILTQVQSKVYADFQNDQKDVRDGK AIRTYKKGMPIPFPWRNNIRMEPVKKGREYEFYIKWYNDIRFQLIFGKDRSNN RLILQRCFKLDENCVEDYQMRTSSIKMVKGANGTELFLYLVVDIPQEKHILNN KIVVGVDLGINVPAYVATNVTDDRKAIGDREHFLNTRMAISKRFHSFQRLKG TTGGRGKTKKLEPLERLKEKERNWVHTQNHLFSRDVITFALHVKAATIQMED LSGYGKDDEGNVVEEKKFLLGKWSYYELQEMIKYKAKKVGMRVNFIKPAYS SQTCSWCGERGERNSTSFVCTNSECSHYGEDLHADYNAARNIARSKNIIRYE |
| 214 CasM.286285 | MIITRKIQILFAAQGEEFKKDKDTLYKWSNIVHHASNIVASNKYVCDHLQGM VYLTEEGKEAVSELSQKVDDIFNTSRMNTTYRMISSLYKGEIPTDILSCVNMQ VSKLYNKERKKMADGDRSLRSYRSNIPIPFSANSLMRKWKYADKEYSFDLFG IPFKVVLGKDKSNNRSILERLMDGTYKAATSSIKIQNCEDETGKKTRKFFLLLC VEIPDKSYAGREDNILFAELSIDHPLLVSFPIKKEESKPIPIGNKQSYLYKRLQIQ KGLDSCKASCKWNKGGRGRKRKMKSTERFKAKEHNFVDAYMHQISAALIKF AIKHDIGKLCLVDVDKKIKEAKESPFVLRNWSYYSLLTKIQYKAKMNGITVV MVDKNVL |
| 215 CasM.286678 | MPTITRKIRLHLCTDGLSEEEERKAQWKMLYRINDNLYRAANNISSKLYLDEHI SSMVRLKHAEYTSLKTELLKAKKADDEETVAELEARINVLNAELSAQEEAICS YATEMATRTLAGKFASELDLNIYGQILAEVKSVVFKNFNSDSKDVREGKRSIR TYKKGMPIPFPWNKTIRLEAVKKESSSKHDEDEYEVYLNWYKSSRTEKKAIR FRLDFGKDKSNNQQIVKRCLNLDNTSSESYQLQTSSIQMKKGSEGAELYLLLV VNIPQDQHVLNKKIVVGVDLGINVPAYVATNCTEERKSIGDREHFLNARIAFH RRFHSFQKLKGTTGGRGRKKKLEPLERLREKERNWVHTQNHLISRDVINFAL QTKAATIQMEDLSGYGKDEEGNVKPENKFLQSRWSYFELQSMIKYKAAKCGI KVNLINPSYTSQTCSWCGQMGVRESTSFVCQNPECKKYGKDIHADYNAARNI ARSNKTVKNE |

TABLE 1-continued

Exemplary Amino Acid Sequences of Effector Proteins

| SEQ ID NO: Effector Protein Name | Effector Protein Amino Acid sequence |
|---|---|
| 216 CasM.287128 | MPTITRKIELRLCTEGLSDEERKAQWMLLYHINDNLYRSANNISSKLYLDEHV SSMVRLKHAEYQSTAAELLKAKKNNADEGTISTLEDKVETLKTEMSAQGIAI CNYATEMATRTLAGKFASELELNIYGQILAEVKNVVHTNFTNDAKEVREGKR SIRTYKKGMPIPFPWNKSIKIEPVKASSQNEGQDDYEFYLKWYNGLKFILHFG KDRSNNRQILKRCFGLDNLCNERYQMRTSSIQMKKGSNGMELYLLLVLSIPK EQHSLNKKVVVGVDLGINVPAYVATNCTEERRAIGDREQFLNTRMAIIRRKH SFQRLKGTAGGRGRKKKLDPLERLRETERNWVHTQNHLYSRDIIKFALETKA ATIQMEKLKGFGRDDNGNVIEEKKFLLGKWSYYELQNMIKYKAGKVGIKVN FIAPAYTSQTCSCCGVRDDRNRKSTSFICHNPDCQMYGKEIHADYNAARNIAR SKNVIKDE |
| 217 CasM.287826 | MPAITRKIELTLCTEGLSEEQRKEQWGLLYHINDNLYKAANNISSKLYLDEHV SSMVRMKHADYLSLLKELARAEKQKTPDDELIAELREKLSLAEQEMTDQELA ICNYATEMATSTLAYNFAKEIETEIFGQILACLENNAHAVFVDDSPTVRRGER AIRNYKKGMPIPFPWNKSIRIVEKDGEFYLRWYNGMRFLLTFGKDRSNNRIIM KRCLKMDQDFEGEYKLCNSSIQMVKREGKTKLFLLIVVNIPQEHVELNKNIV VGVDLGVNVPAYVATNITEERKAIGDREHFLNTRMQFQRRYKSLQRLKGTA GGKGRTKKLEPLERLRKAEHNWVHTQNHLFSREVVNFAVQTRAATIHMEDL SGFGKDNDGNADEQKEFVLRNWSFYELQNMIAYKAAKYGIKVEKVKPAYTS KTCSWCGQLGFRQGVTFICENPACKQCGEKVHADYNAARNIANSKDIIKKNE |
| 218 CasM.287896 | MAGQRHTKVAKFQILKPAADMRWSELGRLLRDAQYRVYRLANLALSEKYL RFHLFRTGQTESLPECRIGRLNRQLRQMLKDEGGADDSVLDRFSRTGALPDT VVGALWQYRLHALTKGEKWNKVTRGETALPTFRRSMALPIRCDKRIHHRLE RAALDSVELDLMICTRPYPRVILKTAKLDDGAAAILERLLDNEGQLLEGYRQR CFEVRYAEDEKAWWLHVTYDSPATPAPHLSKDIIVGVDLGFSCPMYVALSNG DARLGRRQFAALAARIRSLQTQVMARRRQMLSGGKASLSGDTARSGHGRKR KLLPIESLEGRINRAYTTLNHQLSISVVHFAVHHGAGVIQIENLEGLQNELTGT FLGQRWRYHQLQEFLNYKANEAGIEVRRVNPRYTSRRCSKCGYIHVDFNRAF RDAARQEGKVARFCCPKCEYEAHPDYNAARNLATVDIEGIIKVQCERQGIDR PSVENQDEVAK |
| 219 CasM.287936 | MPTITRKIELTLCTEGLSDQERKDQWNLLYHINDNLYRAANNISSKLYLDDHV GSMVRLKHAEYLSLLRALEKAKKQKAPDEEVIAELSQQVATAEQEMDEQAK AICQYATEMSTQTLSYRFATELETNIFGQILTCLRQGVFSTFNSDARDVKRGE RSIRTYKKGMPIPFPWNDSLRIGFEDGEFYLRWYNGLRFRFDFGKDRSNNRLI VQRCMKMDKDYEGDYKLCNSSIQMVKREGKPKFFLLLVVNIPQERVELNKN IVVGVDLGINAPAYVATNTTPERKQIGDREHFLNERMAFQRRFKSLQRLKSTT GGRGRAKKLEPLERLRKAEQNWVHTQNHLFSREVIDFAVKARAATIHMEDL SGFGKDRDGNADERKEFVLRNWSYYELQNMITYKAAKYGIKVEKIRPAYTS KTCSWCGHQGFREGITFICENPECKKFGEKEHADYNAARNIANSKEIIKNNEE |
| 220 CasM.288450 | MPTITRKIELSLCTDGLSDEQLKEQRQLLYHINDNLYRAANNVSSKLYLDEHV SSMVRLKHADYLSLLRDLARAEKQKSPDEALISELRSKLAAAQREMTEQELA ICRYATEMSTQSLSYRFVTEMETHIFAKILDCLKQGVYATFNSDARDVKRGER SIRNYKKGMPIPFAWSDSVRIEQEADEFYLRWYNGIRFRLVFGKDRSNNRLIV KRCLKLDKDYEGDYKLCNSSVQMVKREGKPKTFLLLVVKIPQEQVELNKKIV LGVDLGINYPVYAATNCTEERIYFGEREHFLNTRMQFQRRYKSLQRLKGTTG GKGRKKKLEPLERLRKAERNWVHTQNHLFSQKTVDFALQTHAATIHLEDLS GFGKRDSDGSAEEKKEFVLRNWSYYELQQMITYKAAKYGIKVEKIRPAYTSQT CSWCGQRGFRQGVTFICENPECKKCGEKEQADYNAARNIAKSKDVIKDDDE |
| 221 CasM.288712 | MSIVTRKIELIPDIENLTHEESNQRCYKLLYNIDKKLYKLANLLVCQLFGLDNL LSLMRLQNDEYVKFQSKLASKSISKETQKNIKEHMKEIDKELLARKAEIAPKS PLTFAYRAIKGSLYAKDLPSDIFNTLKQDVFKHFNETKKEQLRGERSLATYKR GIPIPFSLMKKNVIVSEGDNYYLTWFEETRFKLNFGKDRSNNRAIIDNCLKTN KYKLCTAAKIQLKNKKLFFLVTVDIPETKNTIIKGKVMGVDLGVVHPAYVAV NDGPERSLIGDGDAFQKQRDVFRRRFKELQRCQLTQGGHGRKHKTKATEILR GKERNWVQTENHRISRKIVNLAIRWKVESIQMENLKGFGKDSEGEVETKHKR LLGRWSYFELQKDIEYKAQKAGIKVVYINPAYTSQTCHVCGKKGDRTERDTF ICLNTECSCYGKPQDADMNAAINIARSKNIVK |
| 222 CasM.289248 | MPTITRKIELMLCSEGLSDEQRKEQWGLLYHINDNLYKAANNISSKLYLDEHV SSMVRMKHAEYLSLLKELARAEKQQTPDEGLIAELSRKLSAAEKEMADQEL AICKYATEMSTQTLSYNFAKEIETNIFGQILTCLRQGVYATFNSDAKDVKRGE RAIRNYKKGMPIPFPWNKSLKIEAEGGDFYLRWYNGLRFLLTFGKDRSNNRM IVKRCMKMDEDFEGEYKLCNSSIQLAKRDGKPLFLLLVVNIPQEHVELNKKI VVGVDLGVNVPAYVATNITEERKAIGDREHFLNTRMAFQRYKSLQRLKGT AGGKGRTKKLEPLERLRDAERNWVHTQNHLFSREVVNFAVQARAATIHMED MSGFGKDKDGNADEKKEFVLRNWSFYELQNMIAYKSAKYGIKVVKIRPAYT SKTCSWCGQQGERKSTTFICENPECKHYGESIHADYNAARNIANSNDIVKENE |

TABLE 1-continued

Exemplary Amino Acid Sequences of Effector Proteins

| SEQ ID NO: Effector Protein Name | Effector Protein Amino Acid sequence |
|---|---|
| 223 CasM.289726 | MVITRKIEVFVCESDNDLRRSYYEKLYDIRNIAQEAANRATSMLYAIDNLIPCL DEDSRKLIQYIGAKGTPASRQNAAYTIMSHLYKDRMPGIMDMLSNLAQYVT KNYSEDRKRGMYKNALRSYKCSLPVPYQKKSFKGLRFNWYEDSDGDAHEG CFFSLAGVPLQMRFGRDRSNNRLIVERVISGEYKMCTSSLKFDGKKLFLLLCV DIPKQEANVDPKKTLYAYLGVMNPIICTCDVRAKQEYDSGYKCFEIGTKEEFN YRRRQIQEAVRRCQINNRYSSGGKGRKKKCQAIERWHEKEKNYVDTKLHTY SRMLVDLAVAHKCGTIVLLNQKKREDKAKDDNQNGEPFVLRNWSYYNLKD KIGYKCKLAGIKLVQDKEETEEE |
| 224 CasM.289802 | MVITRKIEVFVCEDSKDLRKEYYDKIYKCRDIAVKTANLGVSHLFMLDNTTP YLSDDDREKLTFLGCSGKKATKQNAPYVAASEKFKGQADMSMLSSVLQNVG KMYQDDKKKGMWSKSLRSYKANMPIPFKASCYRNLRFADYNDKEDKPHNG CFFTLMGIPFQCKFGKDRSGNRIIMQAVVDGKYKMCTSSLQIDGKKIFLLLCV DIPKKVVKLDESKTLYAFLGVMNPIVCTTDIKQKGDIDTDWKLWEIGTEAEFN YRRRQIQEAVKRCQVNNRYSRGGHGRFAKTKAIERWRAVERNYVDTKLHTY SKMLIDLAVKHKCGKIVLMNQLHREDAAKDDKFVLRNWSYHSLRTKIDYKA KMYGIKVEVEK |
| 225 CasM.290380 | MPVITRKIKLNLCTEGLSEDERKAQWKMLYRINDNLYRAANNISSKLYLDEH VSSMVRLKNAEYTSLVSDLMKAKKAEDEAAITDLEAKIESLKSEMTAQEEAI CCYATEMATRTLAGKFASELDLDIYGQILAEVKSVVFKNFNSDSKEVREGNR SIRTYKKGMPIPFPWNKTIRLEAVKKELSGKHDEDEYDFYLNWYKSSRTDKK AIRFRLYFGKDKSNNQQIVKRCLHLDSTSSENYQMQTSSIQMKKGPEGAELY LLLVVNIPQEQHALNKKIVVGVDLGINVPAYVATNCTEERKAIGDRDHFLNT RMAFSRRFHSFQRLKGTSGGKGRKKKLEPLERLREKERNWVHTQNHLISRDV INFALQVKAATIQMEDLSGYGKDEEGNVKPENKFLQSKWSYFELQSMIKYKA AKCGIKVNLIAPAYTSQTCSWCGQMGIRESTSFVCQNPECKQYGKDIHADYN AARNIARSNKIVKNE |
| 226 CasM.292901 | MRISKTLSLRIVRPFYTPEVEAGIKAEKDKREAQGQTRSLDAKFFNELKKKHS EIILSSEFYSLLSEVQRQLTSIYNHAMSNLYHKIIVEGEKTSTSKALSNIGYDEC KAIFPSYMALGLRQKIQSNFRRRDLKNFRMAVPTAKSDKFPIPIYRQVDGSKG GFKISENDGKDFIVELPLVDYVAEEVKTAKGRFTKINISKPPKIKNIPVILSTLR RRQSGQWFSDDGTNAEIRRVISGEYKVSWIEIVRRTRFGKHDDWFVNMVIKY DKPEEGLDSKVVGGIDVGVSSPLVCALNNSLDRYFVKSSDIIAFNKRAMARR RTLLRQNKYKRSGHGSKNKLEPITVLTEKNERFKKSIMQRWAKEVAEFFRGK GASVVRMEELSGLKEKDNFFSSYLRMYWNYGQLQQIIENKLKEYGIKVNYVS PKDTSKKCHSCTHINEFFTFEYRQKNNFPLFKCEKCGVECSADYNAAKNMAI A |
| 227 CasM.293203 | MEEKTKRLQKVAKFQIVKPVNMTWVELGKMLRDVRYRLWRLANMAVCEN YMRFYQWRIGKTDANENHKVKILNRRLREMIIEEKQADAKELMRYSRDGVV SGYICGAFEKIHLSAIKNKSKWREVIRGKSNLPLFKRDLPIPINCSDHKPSLIAK TESDEYEVDLRICQKPYPRVLLSTAKISGGERAILERLVSNKTNSLPGYRHRFF EIKEKPKGRWNLHVTYDFARSEATMLHSDIIVGVDLGWSVPLYAAVNKGHA RIGWRKLEPLAKRIRHLQKQVKARRLSVQKGGQRDLAAPTARAGHGRKRIL QPIEKLEGKIDDAYKTLNHQLSHCVIEFAKNNGAGVIQVENLEGLKDTLTGTF IGQNWRYNQLQNYIEYKAKEAGMELKKVNPCQTSQRCSNCGFIHRDFTFEYR QANKKNGKAAMFECPECSKKENYKPLNADYNAARNLATAGIEGKIRLQCEK QGIEYKGLPEE |
| 228 CasM.294190 | MSKITRKIEIIPDIEGLTHDESNKKCYGAFYTFDKNLYKVANLLVSQLYGLDN LLSLMRLQNDEYVKCQSKLSLKSTTDAEKENLKKRMKKIDAELVSIKNGMAP KHPQTFAYRAVTNCVYAKNIPSDILNTLKQDVYKHFNDTKKEQFLGERSLTT YKRGMPVPFSIEKKHAIVCDGDNYYLPWFEDTRFRLNFGRDKSNNRAIIDNCI KTKRYKLCAAAKIQLKDKKLFLLVTVDIPATETTSVKGKVMGVDLGVVNPA YVAVNDGPERSRIGNGEAFQKQRDVFRRRFRELQRSQLTQGGHGRKHKTKA TETLRGKERNWVQTENHRISREIVNLASRWKVECIQMESLKGYGKNQEGEVE DNHKRLLGRWSYFELQKDIEYKAAMVGIQVKYINPAYTSQTCHVCGQRGNR IERDTFICTNPECTCYNQAQDADMNAAINIAKSKDVVK |
| 229 CasM.294406 | MPTITRKIEMKLCTEGLSDQERKDQWNLLYHINDNLYRAANNISSKLYLDDH VLSMVRLKHAEYLGLLRALEKAKKQKIPDEEVIAELSQKVAAAEQEMDDQA KAICQYATEMSTQSLSYRFATELETGIFTKILDCLKQGVFATFNSDTRDVKRG ERSIRTYKKGMPIPFAWNDSLRIELEDGEFYLRWYNGLRFRFDFGKDRSNNRL IVRRCLNMDEDYEGDYKLCNSSIQMVKREGLAKFFLLMVVNIPQEQVELNKK IVVGVDLGINAPAYVATNITSERKQIGDREHFLNERMAFQRRFKSLQRLKGTT GGRGRAKKLEPLERLRKAEQNWVHTQNHLFSREVIDFAVKSRAATIHMEDLS GFGKDRDGNADDKKEFVLRNWSYYELQSMITYKAAKYGIKVEKIRPAYTSK TCSWCGHQGFREGITFICENPECKKYGEKEHADYNAARNIANSIEIVKNNEE |

TABLE 1-continued

Exemplary Amino Acid Sequences of Effector Proteins

| SEQ ID NO: Effector Protein Name | Effector Protein Amino Acid sequence |
|---|---|
| 230 CasM.294601 | MKDYIRKTLSLRILRPYYGEEIEKEIAAAKKKSQAEGGDGALDNKFWDRLKA EHPEIISSREFYDLLDAIQRETTLYYNRAISKLYHSLIVEREQVSTAKALSAGPY HEFREKFNAYISLGLREKIQSNFRRKELARYQVALPTAKSDTFPIPIYKGFDKN GKGGFKVREIENGDFVIDLPLMAYHRVGGKAGREYIELDRPPAVLNVPVILST SRRRANKTWFRDEGTDAEIRRVMAGEYKVSWVEILQRKRFGKPYGGWYVN FTIKYQPRDYGLDPKVKGGIDIGLSSPLVCAVTNSLARLTIRDNDLVAFNRKA MARRRTLLRQNRYKRSGHGSANKLKPIEALTEKNELYRKAIMRRWAREAAD FFRQHRAATVNMEDLTGIKDREDYFSQMLRCYWNYSQLQTMLENKLKEYGI AVKYIEPKDTSKTCHSCGHVNEYFDFNYRSAHKFPMFKCEKCGVECGADYN AARNIAQA |
| 231 CasM.294655 | MPFKVLKLKIIKPVNMDWNELGQSIRDTRYRVYRLANLAVSEAYLAFHLWR AGKTDAIPKATAGQLNRRLRDMLLEEARTKAVKDRKNTGEKGTEDDAKKA QKEMNKFSKTGALPDTVAGALFMYKVKGLISKGKWTQVIRGKSALPTFRNN MAIPIRCDKKTQRRLERTENGVELELMIRNKPYPRVLLGTQGIGEGAEAIIERL LSNESQAEQGYKQRYFEVREDVNRTWWLYVCYALPASTPPRLDPSKIVGVD LGFTCPMYAAISNGHARLGYRAFSSLAARVKALKLRTMRRREIQRGGRTIV SGEAARSGHGRKRKLLGIEKLQGRVNQAYTTLNHQMSAAVVKFAIENGAGTI QVENLEGLREELSGTFLGQMWRYFQLQEFLQYKAEENGIVIRKVNPRYTSRR CSQCGHINKEFTRKARDRNAEGGYSAKFKCPDCEYEADADYNAAKNLAVDG IEGIIEKQCGSQGIVL |
| 232 CasM.295201 | MFLYKELKTMAKTNAEEGKIENKEKRLTKVAKFQIVKPVNMTWPEFGKMLG DVRYRLSRVANMAVTEKYLESQQKRTGQKIQRENTLVTIANRKLREMLKKE KVKEEELDRYSRDGAVSGYVTGPFEHNKLSAISKRFKEVLKGNMSLPNFKRE MAIPINCSNAKLSTIEKTETGEYVVDLRISQKPWPRVLLSTNRISNGQREILERL AANKTFSDDGYKHLFFEVKQQGKDWFLSVTYSFPKSEAPKLHKDIIVGVDLG WSVPLYAAVNKGYARIGWQKFRPLAERIKHLQKQVKARRITIQKGGQQDLA TPTARTGHGRKRILRPIEKLERKIENAYTTLNHQLSHCVIEFAKNNGAGVIQIE NLSGLANELSGTYIGQNWRYEQLQEYIRYKAEEAGIEVKHVNPCRTSQRCSE CGFINDKFNFEYRQANRNNGMSAMFECPECKKNKDYKPINADYNAAKNLT TANIDEIIRLQCKKQGIEYKELPKD |
| 233 CasM.296640 | MSKITRKIELIPDIENLTHEESNQRCYKVFYNIDNKLYKVANLLVCQLFGLDNL LSLMRLQNDEYVKCQSKLASKSISEETKRDIKKRMEAIDKELLARKDEIAPKH PQTFAYRAIKDSDYAKDLPSDIFNTLKQDVFKHFNETKKEQLRGERSLTTYKR GIPVPFNLMKKNVIVSDGDNYYLTWFEETRFKLNFGKDRSNNRAIIDNCLKTN KYKLCTAAKIQLKNKKLFLLVTVDIPETKNKIIKGKVMGVDLGVVHPAYVAV NDGPERSLIGDGDAFQKQRDVFRRRFRELQRCQLTQGGHGRKHKTKATENL RGKERNWVQTENHRISREIVNLAIRWRVETIQMENLKGFGKDSDGDVETKHQ RLLGRWSYFELQKDIEYKAAMAGIKVVYVNPAYTSQTCHVCGERGDRTERD TFICTNTECDCYGKPQDADMNAAINIARSKNIVK |
| 234 CasM.296642 | MTKVVKLPLICEQSDKDGNPIDYKKIYEILFELQRQTREIKNKSIQYCWEFSNF SSDYYKQNHEYPKEKDILSYTLVGFVNDKFKTGNDLYSGNCSTTVRGACGEF KNSKTDFLKGTKSIINYKGNQPLDLHNKTIRFECIGKDYYAYLKLLNRPAFQR NNFSSSEIKFKVLVYDNSSKTIVERCIDNIYKISASKLIYNEKKKCWVLNLSYSF TNNNVCELDENKILGVDLGIHYPICASVNGERKFFKIDGGEIDHTRRKIEVRKK SLLKQGSSCGEGRIGHGIKTRNKPVYNIEDKIACFRDTANHKYSRALINYAVN NNCGIIQMEKLTGITADSDRFLKNWSYFDLQTKIEYKAKEAGITVVYIDPQYT SQRCSKCGYISKENRKVQAKFCCQKCGYEANADYNASQNIGIKDIDKIIKNTK |
| 235 CasM.298142 | VPITKTISLRILRPYYPPEIEAKIKAEKEKRKENGDTGSLNSSYYRELKKEYPSII INDEFFPLLSEMQRNITSIYNRTISHLYHRLIIKKESISTAKALSEGPYRDFKSTF NSYIALGLRQKVQSNFRKKDLMAFKIALPTAKSDKFPIPIYMQTNFKIKESPDS DFIIELPLVEYIAKETKGKNKMFTKVEILSPPKVKNIPVILSTRRRKESGQWFSD EGTNAEIRRIISGEYKVSWIEIVKRTRFGKHDWFVNMVISFEESQEGLDPDVIG GIDIGVSKPLICAINNSLDRYIVKGDDIIAFNRRALSRRRSLLRRNRLKRSGHGS RNKLEPITVLTEKNERFKKSIMQRWAKEVAEFFKSKRASIVQMEELTGIKERE DFFSKTLRMYWNYGQLQKTVENKLREYGIEVRYASPKDTSRRCHSCGHIND YFTFEFRQQNNFPLFKCMNCGIECSADYNAARNIAIAR |
| 236 CasM.298248 | MNRIYQGRVSKVEIPDGKDEWKKLDDGESALWQHHQLFQDDVNYLLAAFA ALVPTSCEDDIWKDYQAAIERSWESYTGRQGIWDRPFENACVIVGCKKDASF KEFRRKLNSLTGSKASEKQKFEALKQLFEPATEAAKKLKKHDEPVEESLKGK AKDLFGSTLVNLCAQKTKVTPRDVIAKQRNRASECTKKVNEGERLKWADVF YFKTDTSAAKWSREDAAKNIIQFLDKLLGEVEEKEKDAKTSDQKKKMADLA ERLEKQKKPLAAWCNNSKTDLPTTEPTRKGSGGYDLKAAVLFSLQPDLDGFR DAFLLFNQARLKEEFATTEKGDAAYIARMAGGVARPVFPFFCDVWAGKVND EKIGQGIWPDFEKQAFSEVFTKIGQFIVRGRKFELRLAIADQIIAKIETQKKSDA RLQAVERIAEDLADELPDTAVDENGQKRPYGIRERTLKGWRKVRPAWREAL KKTPNLTAEDLIKQKNRMQERQREKYGSASLFDRLAKEPEIWNHDDKEDAV |

TABLE 1-continued

Exemplary Amino Acid Sequences of Effector Proteins

| SEQ ID NO: Effector Protein Name | Effector Protein Amino Acid sequence |
| --- | --- |
| | ETWADYVENLEEKAHLETERLFAPAHATLSPRFFRWSETNNKEHLEASSPDV PFELKADALDLSKKEKSQIKIHFWSPRLWRDGLRGKKENLDKDEPDQNWMP PVLRAFVKARKWPCDKQSFAGASVRLAPRCKENIQLVFEPELHTEILSAKWK ENFPFSPAKNKESESVGLFWPRTKEDKVLWFDKGETRCLGVDLGLTNSAAW QILQATNKDATAKAPRLRHRLNPDSEKAAWFAHSITNGIVRVAGEDCWGWR KFAPDEKAKLRAELKKPAGKRNALCRKFLSLNREIEFETATHSFLPELSGSGG RNPTDDETKEAAEFFSTLKTKGFDITDRQPSWGKNLSFPKQNDELLWGLKRV RAQLFRLNRWSEQLGKERDSKPYQSAIEIIGNLRSDDPLIELATLKSEPKRLKS RIAELAGEYLDCFKTLLPRIADRILPWRRGHWSWKPCDNDWHRMELDASKP RPEALLAGQRGISLPRLNQLKDLRQLAQSLNHLCRRKQIKRNETVPEPFEDCR QAMEDAREDRAKKIAHEVFAIALGVELAPPPPDKQERKQTESLHGVYRCLER GPVNFIALENLGGYNPSAKQGRRENRQLSSWLKGRIHKILGELCEMVGMPIV LVNAEYTSRFSAKDHSPGFRAEEVQTDDSRRSFWQRKAKEEPSGWQNEFLC WLNKVPDGKSLLLPKKGGEFFVPLGEGTSLYHADLNAAYRIALRALAHRDR AELLGQTWIEKKPYLVDVAGVFPDSILRNGCAFKTISSSERLWEKVNGDLAM QRCREINLARFASWKIALPQQIISEALPPDEEDDIPM |
| 237 CasM.298264 | MSEATKTLAYRYRLRLTPAQEDILDRSQEQLRLVWNHLVRSQHKVEHEWRH GRAASIKNELLELSLAKNATGQAIPSARKITEERGVSMEEALRLMRQKFVEKV SAIPLRKKDGSRCLRIARRKMATEYAVTVVNAKFKHYYGLGARMCKVLRDK FQKCSDMWIKGKFRRPRFKRKGESVALQRQVQSNSPFKLKRFSDLSALGGQA LKKCEVIIHRPLPDSAEIKQIAVSGRRGQRHLIVMFKAASSDVAKNFPATNRT AGVDPGIKVALTITPLDSPDFGTSDKIEKQPDLARDACFLKRLRRLQRKHDRQ RRQNNPECFDEKGRWIKGKRLHNESKNMQRTQSRITAMNTHLAESRRDFYH NAACEILRSFDNVAVGKWRPAQTRQRKPTTPSPKGLGAARRATNRISYDHAI SLFISYLKDKAERSVTTKHVQEVSEFGSTRSCPKCGKLTGPVGTEGLAVRDW TCVNCNTTFQRDAASAWQIAKRFKAEVASTSQPAESQDSANSASVLTQV |
| 238 CasM.298446 | MPTLTRKVELYVVGDKEEVSRVYDYIRLAMNATYKCFNECMTALYIAQVKE DTKEDRKELNHLYSRQTYTKKETAFTNDIVFPEGLALAAYVNRMAQQKFVT SLKNGLMYGCVSLPTFKKDCAVPLHVKFVSLAGEKGTNTGFYHEYADVNDL VNALEYDNSPKVFLRFPNNITFGVVFGNPYRGREQRSVFSKIFLGEYKIQGSSI QINSRGKIILNLSMEVPKKKMEHIEGRVVGVDVGLAIPAMCAINDDDYTRSAI GNIDDFLKVRTQIQSQRRRLQKSLKNTSSGHGRTKKLKPLERIAEKERNFANT YNHMVSKRVVDFAVKNGASQINIEDLSGFAKDKNGKSVEDDNMKRVLSNW SYFELQQQIRYKAEQYDIKVRTVNPAYTSQTCSYCGQIGKRETQSKFVCTNPD CKCHKMYKKDWFNADFNAARNIALSTDYTDDEDGKKTKKKKSAKKKPEKK TEEA |
| 239 CasM.298612 | MSGASGQITRDNKAQRSGPNKGEMSEDHSSTKRPKRVVKVAKYRIIKPVGEM TWPELGEILRTVRYRVFRLGNLAVSEAYLNFHAFRTGKAEEFKSETIGKLSRR LRDMLISEGVKKEDIDRYSATGAVPDTVAGALGQYKVRGITSPAKWRQVIG TVSLPTFRNDMAIPVRCDKPAQRRLEKAKSEEVEVDLMICRKPYPRVLIGTAD LGGGQQAILERLLDNKDNSSDGYRQRLFEIKQDTQSKKWFLFVTYDFPSSGA LPLDPNVAVGVDLGVSVPLYAAINNGHARLGRRQFQALGSRIRSLQTQVDAR RRAIQRGGRSDVSQSTARSGHGVRRKLQPTEKLRKRIDRSYSTLNHQLSAAV VEFAKNQGAGTVQMEDLGGLREELTGTFIGARWRYHQLQQFLEYKCDEAGI TLNKVNPMYTSRRCSECGFIDKDFDRAFRDRSRDGRVARFICPECSYEADPD YNAARNIATLDIDKLIRVQCQKQGLKYDAL |
| 240 CasM.299584 | MIITRKIELWLSEDDNELRKAKWSYLKELNDEVYRAANFIVNNQYFNEILENR VIMQDTRLIDIDSEIRKLYKSREKNKEKIDELKKIKKIRYQEAKNFYQTSKQNV TYQLTSREFPNIPANIVTSLNASIIKTLKTEWNEIKSGKRAVRNYRKGMPIPFNF SSSQKWFENKGEDIFLNWLGGLKFKLFFGRDKSNNRAIVERAINKEYKYADS SIQLKDKKIFLLFVVDIPYEKANLNKNIAAGVDLGIAFPAFCALSEGYSRLSIG NKEDLLKVRLQMQSRRKRLQKALKITSGGKGRTKKLKALESLTNKEKNYVT TYNHKVSYQVIKFAKDNKAGIIKLEFLEGFGEDEKNKFILRNWSFYQLQKMIE YKAKREGIEVLYIDPYHTSQTCAICGNYEEGQREKQEDFICKNPECKNFEKIV NADYNAALNIAKSNKIVSSSEQCEYNKKHENNVL |
| 728 CasM.286251 (D267A) | MPTITRKIELTLCTEGLSDQERKDQWNLLYHINDNLYRAANNISSKLYLDDHV GSMVRLKHAEYLSLLRALEKAKKQKAPDEEVIAELSQQVATAEQEMDEQAK AICQYATEMSTQTLSYRFATELETNIFGQILTCLRQGVFSTFNSDARDVKRGE RSIRTYKKGMPIPFPWNDSLRIGFEDGEFYLRWYNGLRFRFDFGKDRSNNCLI VQRCMKMDKDYEGDYKLCNSSIQMVKREGKPKFFLLLVVNIPQERVELNKN IVVGVALGINAPAYVATNTTPERKQIGDREHFLNERMAFQRRFKSLQRLKGT TGGRGRAKKLEPLERLRKAEQNWVHTQNHLFSREVIDFAVKARAATIHMED LSGFGKDNDGNADERKEFVLRNWSYYELQNMITYKAAKYGIKVEKIRPAYT SKTCSWCGHQGFREGITFICENPECKKFGEKEHADYNAARNIANSKEIIKNNE E |

TABLE 1-continued

Exemplary Amino Acid Sequences of Effector Proteins

| SEQ ID NO: Effector Protein Name | Effector Protein Amino Acid sequence |
|---|---|
| 729<br>CasM.19952<br>(D267A) | MPTITRKIELTLLTEGLSEEQRKEQWGLLYHINDNLYKAANNISSKLYLDDHV<br>SSMVRMKHAEYLSLLKELARAEKQKTPDADAIAELRKKVAAAEKEMTDQEH<br>AICKYATEMSTQSLSYRFATELETNIFAKILDCLKQGVFATFNSDARDVKRGE<br>RAIRNYKKGMPIPFAWDKSLRIEKDNKDFYLRWYNGLRFLFNFGKDRSNNRL<br>IVERCLKMDADYDGEYKLCNSSIQIAKREGKTKLFLLLVVKIPQEHVELNKKV<br>VVGVALGINVPAYVATNITEERKAIGDREHFLNSRMAFQRRYKSLQRLRGTA<br>GGKGRAKKLEPLERLRKAEHNWVHTQNHLFSREVVDFAVKSHAATIHMEDL<br>SGFGKDNDGNADERKEFVLRNWSYYELQNMIAYKAAKYGIKVEKIHPAYTS<br>KTCSWCGQLGFREGVTFICENPECKQCGEKVHADYNAARNIANSKDIIKKNE |
| 730<br>CasM.19952<br>(D267N) | MPTITRKIELTLLTEGLSEEQRKEQWGLLYHINDNLYKAANNISSKLYLDDHV<br>SSMVRMKHAEYLSLLKELARAEKQKTPDADAIAELRKKVAAAEKEMTDQEH<br>AICKYATEMSTQSLSYRFATELETNIFAKILDCLKQGVFATFNSDARDVKRGE<br>RAIRNYKKGMPIPFAWDKSLRIEKDNKDFYLRWYNGLRFLFNFGKDRSNNRL<br>IVERCLKMDADYDGEYKLCNSSIQIAKREGKTKLFLLLVVKIPQEHVELNKKV<br>VVGVNLGINVPAYVATNITEERKAIGDREHFLNSRMAFQRRYKSLQRLRGTA<br>GGKGRAKKLEPLERLRKAEHNWVHTQNHLFSREVVDFAVKSHAATIHMEDL<br>SGFGKDNDGNADERKEFVLRNWSYYELQNMIAYKAAKYGIKVEKIHPAYTS<br>KTCSWCGQLGFREGVTFICENPECKQCGEKVHADYNAARNIANSKDIIKKNE |
| 731<br>CasM.19952<br>(E363Q) | MPTITRKIELTLLTEGLSEEQRKEQWGLLYHINDNLYKAANNISSKLYLDDHV<br>SSMVRMKHAEYLSLLKELARAEKQKTPDADAIAELRKKVAAAEKEMTDQEH<br>AICKYATEMSTQSLSYRFATELETNIFAKILDCLKQGVFATFNSDARDVKRGE<br>RAIRNYKKGMPIPFAWDKSLRIEKDNKDFYLRWYNGLRFLFNFGKDRSNNRL<br>IVERCLKMDADYDGEYKLCNSSIQIAKREGKTKLFLLLVVKIPQEHVELNKKV<br>VVGVDLGINVPAYVATNITEERKAIGDREHFLNSRMAFQRRYKSLQRLRGTA<br>GGKGRAKKLEPLERLRKAEHNWVHTQNHLFSREVVDFAVKSHAATIHMQDL<br>SGFGKDNDGNADERKEFVLRNWSYYELQNMIAYKAAKYGIKVEKIHPAYTS<br>KTCSWCGQLGFREGVTFICENPECKQCGEKVHADYNAARNIANSKDIIKKNE |

One technological advantage of CasM.19952 is its ability to create a blunt end cut or nearly blunt end cut, also referred to as a "short stagger" cut. This is demonstrated in Example 24. As a consequence of blunt cutting, there is a less likely chance of perfect repair as compared to a Cas nuclease that makes a staggered cut. The substantial overhangs of a staggered cut increases the chances that the cut will "spontaneously" repair, and decrease the chances of successful DNA editing, modification or donor insertion. In some instances, CasM.19952 cleaves double stranded DNA (dsDNA) resulting in two dsDNA ends. In some instances, at least one dsDNA end is a blunt end. A blunt end has no overhanging nucleotides. In some instances, at least one dsDNA end has at least one overhanging nucleotide. In some instances, at least one dsDNA end has less than 10, less than 9, less than 8, less than 7, less than 6, less than 5, less than 4, or less than 3 overhanging nucleotides. In some instances, at least one dsDNA end does not have more than two overhanging nucleotides. In some instances, neither dsDNA end has more than two overhanging nucleotides. Determination of the lack of or extent of an overhang can be determined by Sanger cutsite mapping, e.g., a forward primer to sequence (report on) the target strand and a reverse primer to sequence (report on) the non target strand.

In certain instances, compositions comprise an effector protein and an engineered guide nucleic acid, wherein the effector protein comprises an amino acid sequence that is at least 65%, at least 70%, at least 75%, at least 80%, at least 85%, at least 90%, at least 95%, at least 98%, at least 99%, or 100% identical to any one of SEQ ID NOs: 1-45. In some instances, the amino acid sequence of the effector protein is at least 65%, at least 70%, at least 75%, at least 80%, at least 85%, at least 90%, at least 95%, at least 97%, or at least 98%, at least 99%, or 100% identical to any one of SEQ ID NO: 1-SEQ ID NO: 45.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 1. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 1.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 2. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 2.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 3. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 3.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 4. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 4.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 5. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 5.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 6. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 6.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 7. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 7.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 8. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 8.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 9. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 9.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 10. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 10.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 11. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 11.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 12. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 12.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 13. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 13.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 14. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 14.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 15. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 15.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 16. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 16.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 17. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 17.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 18. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 18.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 19. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 19.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 20. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 20.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 21. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 21.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 22. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 22.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 23. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 23. In some instances, the engineered guide nucleic acid comprises a sequence that is at least 65%, at least 70%, at least 75%, at least 80%, at least 85%, at least 90%, at least 95%, at least 97%, or at least 98%, at least 99%, or 100% identical to the following sequence or an equal length portion thereof: TGGGGCAGTTGGTTGCCCTTAGCCTGAGGCATTT-ATTGCACTCGGGAAGTACCATTTCTC AGAAATGGT ACATCCAAC (SEQ ID NO: 186). The equal length portion thereof may be about 40 nucleotides, about 50 nucleotides, about 60 nucleotides, or about 70 nucleotides.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 24. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 24.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 25. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 25.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 26. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 26.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 27. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 27.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 28. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 28.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 29. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 29.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 30. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 30.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 31. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 31.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 32. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 32.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 33. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 33.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 34. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 34.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 35. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 35.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 36. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 36.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 37. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 37.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 38. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 38.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 39. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 39.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 40. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 40.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 41. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 41.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 42. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 42.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 43. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 43.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 44. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 44.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 45. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 45.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 202. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 202.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 203. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 203.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 204. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 204.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 205. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 205.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 206. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 206.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 207. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 207.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 208. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 208.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 209. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 209.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 210. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 210.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 211. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 211.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 212. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 212.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 213. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 213.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 214. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 214.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 215. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 215.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 216. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 216.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 217. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 217.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 218. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 218.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 219. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 219.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 220. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 220.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 221. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 221.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 222. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 222.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 223. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 223.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 224. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 224.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 225. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 225.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 226. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 226.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 227. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 227.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 228. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 228.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 229. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 229.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 230. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 230.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 231. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 231.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 232. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 232.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 233. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 233.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 234. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 234.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 235. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 235.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 236. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 236.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 237. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 237.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 238. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 238.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 239. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 239.

In certain instances, compositions comprise an effector protein and an engineered guide nucleic acid, wherein amino acid sequence of the effector protein is at least 65%, at least 70%, at least 75%, at least 80%, at least 85%, at least 90%, at least 95%, at least 97%, or at least 98%, at least 99%, or 100% identical to SEQ ID NO: 240. In certain instances, compositions comprise an effector protein and an engineered guide nucleic acid, wherein the amino acid sequence of the effector protein comprises at least about 200, at least about 220, at least about 240, at least about 260, at least about 280, at least about 300, at least about 320, at least about 340, at least about 360, at least about 380, or at least about 400 contiguous amino acids of SEQ ID NO: 240.

In some cases, the D2S effector proteins comprise a RuvC domain (e.g., a partial RuvC domain). In some instances, the RuvC domain may be defined by a single, contiguous sequence, or a set of partial RuvC domains that are not contiguous with respect to the primary amino acid sequence of the protein. A D2S effector protein of the present disclosure may include multiple partial RuvC domains, which may combine to generate a RuvC domain with substrate binding or catalytic activity. For example, a D2S Effector Protein may include 3 partial RuvC domains (RuvC-I, RuvC-II, and RuvC-III, also referred to herein as subdomains) that are not contiguous with respect to the primary amino acid sequence of the D2S effector protein, but form a RuvC domain once the protein is produced and folds. In some instances, a partial RuvC domain is a RuvC subdomain. In many cases, D2S effector proteins comprise a recognition domain (e.g., a REC domain) with a binding affinity for a guide nucleic acid or for a guide nucleic acid-target nucleic acid heteroduplex. An effector protein may comprise a zinc finger domain.

In certain instances, the amino acid sequence of the D2S effector protein comprises an amino acid alteration. In certain instances, the amino acid sequence of the D2S effector protein comprises one or more amino acid alterations. In certain instances, the amino acid sequence of the D2S effector protein comprises two, three, four, five, six, seven, eight, nine, ten or more amino acid alterations. In certain instances, the amino acid sequence of the D2S effector protein comprises two, three, four, five, six, seven, eight, nine, or ten amino acid alterations. In certain instances, the amino acid sequence of the D2S effector protein comprises at least two amino acid alterations. In certain instances, the amino acid sequence of the D2S effector protein comprises at least three amino acid alterations. In certain instances, the amino acid sequence of the D2S effector protein comprises at least four amino acid alterations. In certain instances, the amino acid sequence of the D2S effector protein comprises at least at least five amino acid alterations. In certain instances, the amino acid sequence of the D2S effector protein comprises at least six amino acid alterations. In certain instances, the amino acid sequence of the D2S effector protein comprises at least seven amino acid alterations. In certain instances, the amino acid sequence of the D2S effector protein comprises at least eight amino acid alterations. In certain instances, the amino acid sequence of the D2S effector protein comprises at least nine amino acid alterations. In certain instances, the amino acid sequence of the D2S effector protein comprises at least ten amino acid alterations. In some instances, the amino acid sequence of the D2S effector protein is at least 65%, at least 70%, at least 75%, at least 80%, at least 85%, at least 90%, at least 95%, at least 97%, or at least 98%, at least 99%, or 100% identical to SEQ ID NO: 23 wherein the amino acid sequence of the D2S effector protein comprises one or more amino acid alterations relative to SEQ ID NO: 23.

In some embodiments, the D2S protein comprises one or more amino acid alterations at positions 110, 111, 112, 113, 114, 115, 116, 117, 118, 119, 122, 123, 124, 125, 126, 127, 128, 129, 130, 131, 132, 261, 263, 264, 265, 266, 267, 268, 269, 270, 271, 272, 273, 274, 275, 276, 277, 278, 279, 280, 281, 282, 457, 458, 459, 460, 461, 462, 463, 464, 466, 467, or 468, or any combination thereof, of SEQ ID NO: 23 when the sequence of the D2S protein and SEQ ID NO: 23 are aligned for maximum alignment.

In some embodiments, the D2S protein comprises one or more amino acid alteration at a position corresponding to residue A110, T111, E112, M113, S114, T115, Q116, S117, L118, S119, F122, A123, T124, E125, L126, E127, T128, N129, 1130, F131, A132, K261, V263, V264, G265, V266, D267, L268, G269, 1270, N271, V272, P273, A274, Y275, V276, A277, T278, N279, 1280, T281, E282, E363, I457, A458, N459, S460, K461, D462, 1463, 1464, K466, N467, or E468, or any combination thereof of SEQ ID NO: 23. In some cases, these amino acid alterations could be applied to CasM.19952 or proteins homologous to CasM.19952 (protein homologs), wherein the protein homologs have the same amino acid as CasM.19952 before the amino acid is altered at that position when CasM.19952 and the protein homolog are aligned for maximal alignment.

In some embodiments, the one or more amino acid alteration can be an insertion, deletion, or substitution. In some embodiments, the one or more amino acid alteration can be a substitution. In some embodiments, the one or more amino acid alteration can be a conservative or non-conservative amino acid substitution. In some instances, the D2S effector protein comprises an arginine substitution. In some instances, the alteration corresponds to an alteration shown in TABLE 9, Example 18, or Example 19. In some instances, the one or more amino acid alteration is A110R, T111R, E112R, M113R, S114R, T115R, Q116R, S117R, L118R, S119R, F122R, A123R, T124R, E125R, L126R, E127R, T128R, N129R, 1130R, F131R, A132R, K261R, V263R, V264R, G265R, V266R, D267R, D267A, D267N, L268R, G269R, 1270R, N271R, V272R, P273R, A274R, Y275R, V276R, A277R, T278R, N279R, 1280R, T281R, E282R, E363Q, I457R, A458R, N459R, S460R, K461R, D462R, I463R, I464R, K466R, N467R, or E468R of SEQ ID NO: 23. In some instances, the D2S protein comprises the amino acid alteration T115R, T124R, L126R, E127R, T128R, N129R, A132R, K261R, V263R, T278R, T281R, E282R, N459R, S460R, D462R, K466R, N467R, E468R of SEQ ID NO: 23. In some instances, the D2S protein comprises, the one or more amino acid alteration is T124R, T128R, N129R, T278R, E282R, T281R, or any combination thereof of SEQ ID NO: 23.

When a conservative substitution is described herein, such a substitution refers to the replacement of one amino acid for another such that the replacement takes place within a family of amino acids that are related in their side chains. Alternatively, a non-conservative substitution, when described herein, refers to the replacement of one amino acid residue for another such that the replaced residue is going from one family of amino acids to a different family of residues. Genetically encoded amino acids can be divided into four families: (1) acidic (negatively charged)=Asp (D), Glu (G); (2) basic (positively charged)=Lys (K), Arg (R), His (H); (3) non-polar (hydrophobic)=Cys (C), Ala (A), Val (V), Leu (L), Ile (I), Pro (P), Phe (F), Met (M), Trp (W), Gly (G), Tyr (Y), with non-polar also being subdivided into: (i) strongly hydrophobic=Ala (A), Val (V), Leu (L), Ile (I), Met (M), Phe (F); and (ii) moderately hydrophobic=Gly (G), Pro (P), Cys (C), Tyr (Y), Trp (W); and (4) uncharged polar=Asn (N), Gln (Q), Ser (S), Thr (T). In alternative fashion, the amino acid repertoire can be grouped as (1) acidic (negatively charged)=Asp (D), Glu (G); (2) basic (positively charged)=Lys (K), Arg (R), His (H), and (3) aliphatic=Gly (G), Ala (A), Val (V), Leu (L), Ile (I), Ser (S), Thr (T), with Ser (S) and Thr (T) optionally being grouped separately as aliphatic-hydroxyl; (4) aromatic=Phe (F), Tyr (Y), Trp (W); (5) amide=Asn (N), Glu (Q); and (6) sulfur-containing=Cys (C) and Met (M) (see, for example, Biochemistry, 4th ed., Ed. by L. Stryer, WH Freeman and Co., 1995, which is incorporated by reference herein in its entirety).

In some instances, the amino acid sequence of the D2S effector protein, other than the one or more amino acid alteration as described herein, is at least 65%, at least 70%, at least 75%, at least 80%, at least 85%, at least 90%, at least 95%, at least 97%, or at least 98%, at least 99%, or 100% identical to any one of SEQ ID NOs: 241-293. In some instances, the amino acid sequence of the D2S effector protein, other than the one or more amino acid alteration corresponding to the alteration shown in TABLE 9, is at least 65%, at least 70%, at least 75%, at least 80%, at least 85%, at least 90%, at least 95%, at least 97%, or at least 98%, at least 99%, or 100% identical to any one of SEQ ID NOs: 241-293.

In certain instances, compositions comprise an effector protein and an engineered guide nucleic acid, wherein the amino acid sequence of the effector protein, other than the amino acid alteration at position 110, is at least 65%, at least 70%, at least 75%, at least 80%, at least 85%, at least 90%, at least 95%, at least 97%, or at least 98%, at least 99%, or 100% identical to SEQ ID NO: 241. In certain instances, compositions comprise an effector protein and an engineered guide nucleic acid, wherein the amino acid sequence of the effector protein, other than the amino acid alteration at position 110, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 241.

In certain instances, compositions comprise an effector protein and an engineered guide nucleic acid, wherein the amino acid sequence of the effector protein, other than the amino acid alteration at position 111, is at least 65%, at least 70%, at least 75%, at least 80%, at least 85%, at least 90%, at least 95%, at least 97%, or at least 98%, at least 99%, or 100% identical to SEQ ID NO: 242. In certain instances, compositions comprise an effector protein and an engineered guide nucleic acid, wherein the amino acid sequence of the effector protein, other than the amino acid alteration at position 111, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 242.

In certain instances, compositions comprise an effector protein and an engineered guide nucleic acid, wherein the amino acid sequence of the effector protein, other than the amino acid alteration at position 112, is at least 65%, at least 70%, at least 75%, at least 80%, at least 85%, at least 90%, at least 95%, at least 97%, or at least 98%, at least 99%, or 100% identical to SEQ ID NO: 243. In certain instances, compositions comprise an effector protein and an engineered guide nucleic acid, wherein the amino acid sequence of the effector protein, other than the amino acid alteration at position 112, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 243.

In certain instances, compositions comprise an effector protein and an engineered guide nucleic acid, wherein the amino acid sequence of the effector protein, other than the amino acid alteration at position 113, is at least 65%, at least 70%, at least 75%, at least 80%, at least 85%, at least 90%, at least 95%, at least 97%, or at least 98%, at least 99%, or 100% identical to SEQ ID NO: 244. In certain instances, compositions comprise an effector protein and an engineered guide nucleic acid, wherein the amino acid sequence of the effector protein, other than the amino acid alteration at position 113, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 244.

In certain instances, compositions comprise an effector protein and an engineered guide nucleic acid, wherein the amino acid sequence of the effector protein, other than the amino acid alteration at position 114, is at least 65%, at least 70%, at least 75%, at least 80%, at least 85%, at least 90%, at least 95%, at least 97%, or at least 98%, at least 99%, or 100% identical to SEQ ID NO: 245. In certain instances, compositions comprise an effector protein and an engineered guide nucleic acid, wherein the amino acid sequence of the effector protein, other than the amino acid alteration at position 114, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 245.

In certain instances, compositions comprise an effector protein and an engineered guide nucleic acid, wherein the amino acid sequence of the effector protein, other than the amino acid alteration at position 115, is at least 65%, at least 70%, at least 75%, at least 80%, at least 85%, at least 90%, at least 95%, at least 97%, or at least 98%, at least 99%, or 100% identical to SEQ ID NO: 246. In certain instances, compositions comprise an effector protein and an engineered guide nucleic acid, wherein the amino acid sequence of the effector protein, other than the amino acid alteration at position 115, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 246.

In certain instances, compositions comprise an effector protein and an engineered guide nucleic acid, wherein the amino acid sequence of the effector protein, other than the amino acid alteration at position 116, is at least 65%, at least 70%, at least 75%, at least 80%, at least 85%, at least 90%, at least 95%, at least 97%, or at least 98%, at least 99%, or 100% identical to SEQ ID NO: 247. In certain instances, compositions comprise an effector protein and an engineered guide nucleic acid, wherein the amino acid sequence of the effector protein, other than the amino acid alteration at position 116, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 247.

In certain instances, compositions comprise an effector protein and an engineered guide nucleic acid, wherein the amino acid sequence of the effector protein, other than the amino acid alteration at position 117, is at least 65%, at least 70%, at least 75%, at least 80%, at least 85%, at least 90%, at least 95%, at least 97%, or at least 98%, at least 99%, or 100% identical to SEQ ID NO: 248. In certain instances, compositions comprise an effector protein and an engineered guide nucleic acid, wherein the amino acid sequence of the effector protein, other than the amino acid alteration at position 117, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 248.

In certain instances, compositions comprise an effector protein and an engineered guide nucleic acid, wherein the amino acid sequence of the effector protein, other than the amino acid alteration at position 118, is at least 65%, at least 70%, at least 75%, at least 80%, at least 85%, at least 90%, at least 95%, at least 97%, or at least 98%, at least 99%, or 100% identical to SEQ ID NO: 249. In certain instances, compositions comprise an effector protein and an engineered guide nucleic acid, wherein the amino acid sequence of the effector protein, other than the amino acid alteration at position 118, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 249.

In certain instances, compositions comprise an effector protein and an engineered guide nucleic acid, wherein the amino acid sequence of the effector protein, other than the amino acid alteration at position 119, is at least 65%, at least 70%, at least 75%, at least 80%, at least 85%, at least 90%, at least 95%, at least 97%, or at least 98%, at least 99%, or 100% identical to SEQ ID NO: 250. In certain instances, compositions comprise an effector protein and an engineered guide nucleic acid, wherein the amino acid sequence of the effector protein, other than the amino acid alteration at position 119, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 250.

In certain instances, compositions comprise an effector protein and an engineered guide nucleic acid, wherein the amino acid sequence of the effector protein, other than the amino acid alteration at position 122, is at least 65%, at least 70%, at least 75%, at least 80%, at least 85%, at least 90%, at least 95%, at least 97%, or at least 98%, at least 99%, or 100% identical to SEQ ID NO: 251. In certain instances, compositions comprise an effector protein and an engineered guide nucleic acid, wherein the amino acid sequence of the effector protein, other than the amino acid alteration at position 122, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 251.

In certain instances, compositions comprise an effector protein and an engineered guide nucleic acid, wherein the amino acid sequence of the effector protein, other than the amino acid alteration at position 123, is at least 65%, at least 70%, at least 75%, at least 80%, at least 85%, at least 90%, at least 95%, at least 97%, or at least 98%, at least 99%, or 100% identical to SEQ ID NO: 252. In certain instances, compositions comprise an effector protein and an engineered guide nucleic acid, wherein the amino acid sequence of the effector protein, other than the amino acid alteration at position 123, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 252.

In certain instances, compositions comprise an effector protein and an engineered guide nucleic acid, wherein the amino acid sequence of the effector protein, other than the amino acid alteration at position 124, is at least 65%, at least 70%, at least 75%, at least 80%, at least 85%, at least 90%, at least 95%, at least 97%, or at least 98%, at least 99%, or 100% identical to SEQ ID NO: 253. In certain instances, compositions comprise an effector protein and an engineered guide nucleic acid, wherein the amino acid sequence of the effector protein, other than the amino acid alteration at position 124, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 253.

In certain instances, compositions comprise an effector protein and an engineered guide nucleic acid, wherein the amino acid sequence of the effector protein, other than the amino acid alteration at position 125, is at least 65%, at least 70%, at least 75%, at least 80%, at least 85%, at least 90%, at least 95%, at least 97%, or at least 98%, at least 99%, or 100% identical to SEQ ID NO: 254. In certain instances, compositions comprise an effector protein and an engineered guide nucleic acid, wherein the amino acid sequence of the effector protein, other than the amino acid alteration at position 125, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 254.

In certain instances, compositions comprise an effector protein and an engineered guide nucleic acid, wherein the amino acid sequence of the effector protein, other than the amino acid alteration at position 126, is at least 65%, at least 70%, at least 75%, at least 80%, at least 85%, at least 90%, at least 95%, at least 97%, or at least 98%, at least 99%, or 100% identical to SEQ ID NO: 255. In certain instances, compositions comprise an effector protein and an engineered guide nucleic acid, wherein the amino acid sequence of the effector protein, other than the amino acid alteration at position 126, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 255.

In certain instances, compositions comprise an effector protein and an engineered guide nucleic acid, wherein the amino acid sequence of the effector protein, other than the amino acid alteration at position 127, is at least 65%, at least 70%, at least 75%, at least 80%, at least 85%, at least 90%, at least 95%, at least 97%, or at least 98%, at least 99%, or 100% identical to SEQ ID NO: 256. In certain instances, compositions comprise an effector protein and an engineered guide nucleic acid, wherein the amino acid sequence of the effector protein, other than the amino acid alteration at position 127, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 256.

In certain instances, compositions comprise an effector protein and an engineered guide nucleic acid, wherein the amino acid sequence of the effector protein, other than the amino acid alteration at position 128, is at least 65%, at least 70%, at least 75%, at least 80%, at least 85%, at least 90%, at least 95%, at least 97%, or at least 98%, at least 99%, or 100% identical to SEQ ID NO: 257. In certain instances, compositions comprise an effector protein and an engineered guide nucleic acid, wherein the amino acid sequence of the effector protein, other than the amino acid alteration at position 128, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 257.

In certain instances, compositions comprise an effector protein and an engineered guide nucleic acid, wherein the amino acid sequence of the effector protein, other than the amino acid alteration at position 129, is at least 65%, at least 70%, at least 75%, at least 80%, at least 85%, at least 90%, at least 95%, at least 97%, or at least 98%, at least 99%, or 100% identical to SEQ ID NO: 258. In certain instances, compositions comprise an effector protein and an engineered guide nucleic acid, wherein the amino acid sequence of the effector protein, other than the amino acid alteration at position 129, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 258.

In certain instances, compositions comprise an effector protein and an engineered guide nucleic acid, wherein the amino acid sequence of the effector protein, other than the amino acid alteration at position 130, is at least 65%, at least 70%, at least 75%, at least 80%, at least 85%, at least 90%, at least 95%, at least 97%, or at least 98%, at least 99%, or 100% identical to SEQ ID NO: 259. In certain instances, compositions comprise an effector protein and an engineered guide nucleic acid, wherein the amino acid sequence of the effector protein, other than the amino acid alteration at position 130, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 259.

In certain instances, compositions comprise an effector protein and an engineered guide nucleic acid, wherein the amino acid sequence of the effector protein, other than the amino acid alteration at position 131, is at least 65%, at least 70%, at least 75%, at least 80%, at least 85%, at least 90%, at least 95%, at least 97%, or at least 98%, at least 99%, or 100% identical to SEQ ID NO: 260. In certain instances, compositions comprise an effector protein and an engineered guide nucleic acid, wherein the amino acid sequence of the effector protein, other than the amino acid alteration at position 131, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 260.

In certain instances, compositions comprise an effector protein and an engineered guide nucleic acid, wherein the amino acid sequence of the effector protein, other than the amino acid alteration at position 132, is at least 65%, at least 70%, at least 75%, at least 80%, at least 85%, at least 90%, at least 95%, at least 97%, or at least 98%, at least 99%, or 100% identical to SEQ ID NO: 261. In certain instances, compositions comprise an effector protein and an engineered guide nucleic acid, wherein the amino acid sequence of the effector protein, other than the amino acid alteration at position 132, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 261.

In certain instances, compositions comprise an effector protein and an engineered guide nucleic acid, wherein the amino acid sequence of the effector protein, other than the amino acid alteration at position 261, is at least 65%, at least 70%, at least 75%, at least 80%, at least 85%, at least 90%, at least 95%, at least 97%, or at least 98%, at least 99%, or 100% identical to SEQ ID NO: 262. In certain instances, compositions comprise an effector protein and an engineered guide nucleic acid, wherein the amino acid sequence of the effector protein, other than the amino acid alteration at position 261, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 262.

In certain instances, compositions comprise an effector protein and an engineered guide nucleic acid, wherein the amino acid sequence of the effector protein, other than the amino acid alteration at position 263, is at least 65%, at least 70%, at least 75%, at least 80%, at least 85%, at least 90%, at least 95%, at least 97%, or at least 98%, at least 99%, or 100% identical to SEQ ID NO: 263. In certain instances, compositions comprise an effector protein and an engineered guide nucleic acid, wherein the amino acid sequence of the effector protein, other than the amino acid alteration at position 263, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 263.

In certain instances, compositions comprise an effector protein and an engineered guide nucleic acid, wherein the amino acid sequence of the effector protein, other than the amino acid alteration at position 264, is at least 65%, at least 70%, at least 75%, at least 80%, at least 85%, at least 90%, at least 95%, at least 97%, or at least 98%, at least 99%, or 100% identical to SEQ ID NO: 264. In certain instances, compositions comprise an effector protein and an engineered guide nucleic acid, wherein the amino acid sequence of the effector protein, other than the amino acid alteration at position 264, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 264.

In certain instances, compositions comprise an effector protein and an engineered guide nucleic acid, wherein the amino acid sequence of the effector protein, other than the amino acid alteration at position 265, is at least 65%, at least 70%, at least 75%, at least 80%, at least 85%, at least 90%, at least 95%, at least 97%, or at least 98%, at least 99%, or 100% identical to SEQ ID NO: 265. In certain instances, compositions comprise an effector protein and an engineered guide nucleic acid, wherein the amino acid sequence of the effector protein, other than the amino acid alteration at position 265, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 265.

In certain instances, compositions comprise an effector protein and an engineered guide nucleic acid, wherein the amino acid sequence of the effector protein, other than the amino acid alteration at position 266, is at least 65%, at least 70%, at least 75%, at least 80%, at least 85%, at least 90%, at least 95%, at least 97%, or at least 98%, at least 99%, or 100% identical to SEQ ID NO: 266. In certain instances, compositions comprise an effector protein and an engineered guide nucleic acid, wherein the amino acid sequence of the effector protein, other than the amino acid alteration at position 266, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 266.

In certain instances, compositions comprise an effector protein and an engineered guide nucleic acid, wherein the amino acid sequence of the effector protein, other than the amino acid alteration at position 267, is at least 65%, at least 70%, at least 75%, at least 80%, at least 85%, at least 90%, at least 95%, at least 97%, or at least 98%, at least 99%, or 100% identical to SEQ ID NO: 267. In certain instances, compositions comprise an effector protein and an engineered guide nucleic acid, wherein the amino acid sequence of the effector protein, other than the amino acid alteration at position 267, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 267.

In certain instances, compositions comprise an effector protein and an engineered guide nucleic acid, wherein the amino acid sequence of the effector protein, other than the amino acid alteration at position 268, is at least 65%, at least 70%, at least 75%, at least 80%, at least 85%, at least 90%, at least 95%, at least 97%, or at least 98%, at least 99%, or 100% identical to SEQ ID NO: 268. In certain instances, compositions comprise an effector protein and an engineered guide nucleic acid, wherein the amino acid sequence of the effector protein, other than the amino acid alteration at position 268, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 268.

In certain instances, compositions comprise an effector protein and an engineered guide nucleic acid, wherein the amino acid sequence of the effector protein, other than the amino acid alteration at position 269, is at least 65%, at least 70%, at least 75%, at least 80%, at least 85%, at least 90%, at least 95%, at least 97%, or at least 98%, at least 99%, or 100% identical to SEQ ID NO: 269. In certain instances, compositions comprise an effector protein and an engineered guide nucleic acid, wherein the amino acid sequence of the effector protein, other than the amino acid alteration at position 269, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 269.

In certain instances, compositions comprise an effector protein and an engineered guide nucleic acid, wherein the amino acid sequence of the effector protein, other than the amino acid alteration at position 270, is at least 65%, at least 70%, at least 75%, at least 80%, at least 85%, at least 90%, at least 95%, at least 97%, or at least 98%, at least 99%, or 100% identical to SEQ ID NO: 270. In certain instances, compositions comprise an effector protein and an engineered guide nucleic acid, wherein the amino acid sequence of the effector protein, other than the amino acid alteration at position 270, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 270.

In certain instances, compositions comprise an effector protein and an engineered guide nucleic acid, wherein the amino acid sequence of the effector protein, other than the amino acid alteration at position 271, is at least 65%, at least 70%, at least 75%, at least 80%, at least 85%, at least 90%, at least 95%, at least 97%, or at least 98%, at least 99%, or 100% identical to SEQ ID NO: 271. In certain instances, compositions comprise an effector protein and an engineered guide nucleic acid, wherein the amino acid sequence of the effector protein, other than the amino acid alteration at position 271, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 271.

In certain instances, compositions comprise an effector protein and an engineered guide nucleic acid, wherein the amino acid sequence of the effector protein, other than the amino acid alteration at position 272, is at least 65%, at least 70%, at least 75%, at least 80%, at least 85%, at least 90%, at least 95%, at least 97%, or at least 98%, at least 99%, or 100% identical to SEQ ID NO: 272. In certain instances, compositions comprise an effector protein and an engineered guide nucleic acid, wherein the amino acid sequence of the effector protein, other than the amino acid alteration at position 272, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 272.

In certain instances, compositions comprise an effector protein and an engineered guide nucleic acid, wherein the amino acid sequence of the effector protein, other than the amino acid alteration at position 273, is at least 65%, at least 70%, at least 75%, at least 80%, at least 85%, at least 90%, at least 95%, at least 97%, or at least 98%, at least 99%, or 100% identical to SEQ ID NO: 273. In certain instances, compositions comprise an effector protein and an engineered guide nucleic acid, wherein the amino acid sequence of the effector protein, other than the amino acid alteration at position 273, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 273.

In certain instances, compositions comprise an effector protein and an engineered guide nucleic acid, wherein the amino acid sequence of the effector protein, other than the amino acid alteration at position 274, is at least 65%, at least 70%, at least 75%, at least 80%, at least 85%, at least 90%, at least 95%, at least 97%, or at least 98%, at least 99%, or 100% identical to SEQ ID NO: 274. In certain instances, compositions comprise an effector protein and an engineered guide nucleic acid, wherein the amino acid sequence of the effector protein, other than the amino acid alteration at position 274, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 274.

In certain instances, compositions comprise an effector protein and an engineered guide nucleic acid, wherein the amino acid sequence of the effector protein, other than the amino acid alteration at position 275, is at least 65%, at least 70%, at least 75%, at least 80%, at least 85%, at least 90%, at least 95%, at least 97%, or at least 98%, at least 99%, or 100% identical to SEQ ID NO: 275. In certain instances, compositions comprise an effector protein and an engineered guide nucleic acid, wherein the amino acid sequence of the effector protein, other than the amino acid alteration at position 275, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 275.

In certain instances, compositions comprise an effector protein and an engineered guide nucleic acid, wherein the amino acid sequence of the effector protein, other than the amino acid alteration at position 276, is at least 65%, at least 70%, at least 75%, at least 80%, at least 85%, at least 90%, at least 95%, at least 97%, or at least 98%, at least 99%, or 100% identical to SEQ ID NO: 276. In certain instances, compositions comprise an effector protein and an engineered guide nucleic acid, wherein the amino acid sequence of the effector protein, other than the amino acid alteration at position 276, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 276.

In certain instances, compositions comprise an effector protein and an engineered guide nucleic acid, wherein the amino acid sequence of the effector protein, other than the amino acid alteration at position 277, is at least 65%, at least 70%, at least 75%, at least 80%, at least 85%, at least 90%, at least 95%, at least 97%, or at least 98%, at least 99%, or 100% identical to SEQ ID NO: 277. In certain instances, compositions comprise an effector protein and an engineered guide nucleic acid, wherein the amino acid sequence of the effector protein, other than the amino acid alteration at position 277, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 277.

In certain instances, compositions comprise an effector protein and an engineered guide nucleic acid, wherein the amino acid sequence of the effector protein, other than the amino acid alteration at position 278, is at least 65%, at least 70%, at least 75%, at least 80%, at least 85%, at least 90%, at least 95%, at least 97%, or at least 98%, at least 99%, or 100% identical to SEQ ID NO: 278. In certain instances, compositions comprise an effector protein and an engineered guide nucleic acid, wherein the amino acid sequence of the effector protein, other than the amino acid alteration at position 278, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 278.

In certain instances, compositions comprise an effector protein and an engineered guide nucleic acid, wherein the amino acid sequence of the effector protein, other than the amino acid alteration at position 279, is at least 65%, at least 70%, at least 75%, at least 80%, at least 85%, at least 90%, at least 95%, at least 97%, or at least 98%, at least 99%, or 100% identical to SEQ ID NO: 279. In certain instances, compositions comprise an effector protein and an engineered guide nucleic acid, wherein the amino acid sequence of the effector protein, other than the amino acid alteration at position 279, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 279.

In certain instances, compositions comprise an effector protein and an engineered guide nucleic acid, wherein the amino acid sequence of the effector protein, other than the amino acid alteration at position 280, is at least 65%, at least 70%, at least 75%, at least 80%, at least 85%, at least 90%, at least 95%, at least 97%, or at least 98%, at least 99%, or 100% identical to SEQ ID NO: 280. In certain instances, compositions comprise an effector protein and an engineered guide nucleic acid, wherein the amino acid sequence of the effector protein, other than the amino acid alteration at position 280, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 280.

In certain instances, compositions comprise an effector protein and an engineered guide nucleic acid, wherein the amino acid sequence of the effector protein, other than the amino acid alteration at position 281, is at least 65%, at least 70%, at least 75%, at least 80%, at least 85%, at least 90%, at least 95%, at least 97%, or at least 98%, at least 99%, or 100% identical to SEQ ID NO: 281. In certain instances, compositions comprise an effector protein and an engineered guide nucleic acid, wherein the amino acid sequence of the effector protein, other than the amino acid alteration at position 281, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 281.

In certain instances, compositions comprise an effector protein and an engineered guide nucleic acid, wherein the amino acid sequence of the effector protein, other than the amino acid alteration at position 282, is at least 65%, at least 70%, at least 75%, at least 80%, at least 85%, at least 90%, at least 95%, at least 97%, or at least 98%, at least 99%, or 100% identical to SEQ ID NO: 282. In certain instances, compositions comprise an effector protein and an engineered guide nucleic acid, wherein the amino acid sequence of the effector protein, other than the amino acid alteration at position 282, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 282.

In certain instances, compositions comprise an effector protein and an engineered guide nucleic acid, wherein the amino acid sequence of the effector protein, other than the amino acid alteration at position 457, is at least 65%, at least 70%, at least 75%, at least 80%, at least 85%, at least 90%, at least 95%, at least 97%, or at least 98%, at least 99%, or 100% identical to SEQ ID NO: 283. In certain instances, compositions comprise an effector protein and an engineered guide nucleic acid, wherein the amino acid sequence of the effector protein, other than the amino acid alteration at position 457, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 283.

In certain instances, compositions comprise an effector protein and an engineered guide nucleic acid, wherein the amino acid sequence of the effector protein, other than the amino acid alteration at position 458, is at least 65%, at least 70%, at least 75%, at least 80%, at least 85%, at least 90%, at least 95%, at least 97%, or at least 98%, at least 99%, or 100% identical to SEQ ID NO: 284. In certain instances, compositions comprise an effector protein and an engineered guide nucleic acid, wherein the amino acid sequence of the effector protein, other than the amino acid alteration at position 458, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 284.

In certain instances, compositions comprise an effector protein and an engineered guide nucleic acid, wherein the amino acid sequence of the effector protein, other than the amino acid alteration at position 459, is at least 65%, at least 70%, at least 75%, at least 80%, at least 85%, at least 90%, at least 95%, at least 97%, or at least 98%, at least 99%, or 100% identical to SEQ ID NO: 285. In certain instances, compositions comprise an effector protein and an engineered guide nucleic acid, wherein the amino acid sequence of the effector protein, other than the amino acid alteration at position 459, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 285.

In certain instances, compositions comprise an effector protein and an engineered guide nucleic acid, wherein the amino acid sequence of the effector protein, other than the amino acid alteration at position 460, is at least 65%, at least 70%, at least 75%, at least 80%, at least 85%, at least 90%, at least 95%, at least 97%, or at least 98%, at least 99%, or 100% identical to SEQ ID NO: 286. In certain instances, compositions comprise an effector protein and an engineered guide nucleic acid, wherein the amino acid sequence of the effector protein, other than the amino acid alteration at position 460, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 286.

In certain instances, compositions comprise an effector protein and an engineered guide nucleic acid, wherein the amino acid sequence of the effector protein, other than the amino acid alteration at position 461, is at least 65%, at least 70%, at least 75%, at least 80%, at least 85%, at least 90%, at least 95%, at least 97%, or at least 98%, at least 99%, or 100% identical to SEQ ID NO: 287. In certain instances, compositions comprise an effector protein and an engineered guide nucleic acid, wherein the amino acid sequence of the effector protein, other than the amino acid alteration at position 461, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 287.

In certain instances, compositions comprise an effector protein and an engineered guide nucleic acid, wherein the amino acid sequence of the effector protein, other than the amino acid alteration at position 462, is at least 65%, at least 70%, at least 75%, at least 80%, at least 85%, at least 90%, at least 95%, at least 97%, or at least 98%, at least 99%, or 100% identical to SEQ ID NO: 288. In certain instances, compositions comprise an effector protein and an engineered guide nucleic acid, wherein the amino acid sequence of the effector protein, other than the amino acid alteration at position 462, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 288.

In certain instances, compositions comprise an effector protein and an engineered guide nucleic acid, wherein the amino acid sequence of the effector protein, other than the amino acid alteration at position 463, is at least 65%, at least 70%, at least 75%, at least 80%, at least 85%, at least 90%, at least 95%, at least 97%, or at least 98%, at least 99%, or 100% identical to SEQ ID NO: 289. In certain instances, compositions comprise an effector protein and an engineered guide nucleic acid, wherein the amino acid sequence of the effector protein, other than the amino acid alteration at position 463, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 289.

In certain instances, compositions comprise an effector protein and an engineered guide nucleic acid, wherein the amino acid sequence of the effector protein, other than the amino acid alteration at position 464, is at least 65%, at least 70%, at least 75%, at least 80%, at least 85%, at least 90%, at least 95%, at least 97%, or at least 98%, at least 99%, or 100% identical to SEQ ID NO: 290. In certain instances, compositions comprise an effector protein and an engineered guide nucleic acid, wherein the amino acid sequence of the effector protein, other than the amino acid alteration at position 464, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 290.

In certain instances, compositions comprise an effector protein and an engineered guide nucleic acid, wherein the amino acid sequence of the effector protein, other than the amino acid alteration at position 466, is at least 65%, at least 70%, at least 75%, at least 80%, at least 85%, at least 90%, at least 95%, at least 97%, or at least 98%, at least 99%, or 100% identical to SEQ ID NO: 291. In certain instances, compositions comprise an effector protein and an engineered guide nucleic acid, wherein the amino acid sequence of the effector protein, other than the amino acid alteration at position 466, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 291.

In certain instances, compositions comprise an effector protein and an engineered guide nucleic acid, wherein the amino acid alteration at position 467, is at least 65%, at least 70%, at least 75%, at least 80%, at least 85%, at least 90%, at least 95%, at least 97%, or at least 98%, at least 99%, or 100% identical to SEQ ID NO: 292. In certain instances, compositions comprise an effector protein and an engineered guide nucleic acid, wherein the amino acid sequence of the effector protein, other than the amino acid alteration at position 467, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 292.

In certain instances, compositions comprise an effector protein and an engineered guide nucleic acid, wherein the amino acid sequence of the effector protein, other than the amino acid alteration at position 468, is at least 65%, at least 70%, at least 75%, at least 80%, at least 85%, at least 90%, at least 95%, at least 97%, or at least 98%, at least 99%, or 100% identical to SEQ ID NO: 293. In certain instances, compositions comprise an effector protein and an engineered guide nucleic acid, wherein the amino acid sequence of the effector protein, other than the amino acid alteration at position 468, comprises at least about 200, at least about 220, at least about 240, at least about 260, at least about 280, at least about 300, at least about 320, at least about 340, at least about 360, at least about 380, or at least about 400 contiguous amino acids of SEQ ID NO. 293.

In certain instances, compositions comprise an effector protein and an engineered guide nucleic acid, wherein the amino acid sequence of the effector protein, other than the amino acid alteration at position 468, is at least 65%, at least 70%, at least 75%, at least 80%, at least 85%, at least 90%, at least 95%, at least 97%, or at least 98%, at least 99%, or 100% identical to SEQ ID NO: 728. In certain instances, compositions comprise an effector protein and an engineered guide nucleic acid, wherein the amino acid sequence of the effector protein, other than the amino acid alteration at position 468, comprises at least about 200, at least about 220, at least about 240, at least about 260, at least about 280, at least about 300, at least about 320, at least about 340, at least about 360, at least about 380, or at least about 400 contiguous amino acids of SEQ ID NO: 728.

In certain instances, compositions comprise an effector protein and an engineered guide nucleic acid, wherein the amino acid sequence of the effector protein, other than the amino acid alteration at position 468, is at least 65%, at least 70%, at least 75%, at least 80%, at least 85%, at least 90%, at least 95%, at least 97%, or at least 98%, at least 99%, or 100% identical to SEQ ID NO: 729. In certain instances, compositions comprise an effector protein and an engineered guide nucleic acid, wherein the amino acid sequence of the effector protein, other than the amino acid alteration at position 468, comprises at least about 200, at least about 220, at least about 240, at least about 260, at least about 280, at least about 300, at least about 320, at least about 340, at least about 360, at least about 380, or at least about 400 contiguous amino acids of SEQ ID NO: 729.

In certain instances, compositions comprise an effector protein and an engineered guide nucleic acid, wherein the amino acid sequence of the effector protein, other than the amino acid alteration at position 468, is at least 65%, at least 70%, at least 75%, at least 80%, at least 85%, at least 90%, at least 95%, at least 97%, or at least 98%, at least 99%, or 100% identical to SEQ ID NO: 730. In certain instances, compositions comprise an effector protein and an engineered guide nucleic acid, wherein the amino acid sequence of the effector protein, other than the amino acid alteration at position 468, comprises at least about 200, at least about 220, at least about 240, at least about 260, at least about 280, at least about 300, at least about 320, at least about 340, at least about 360, at least about 380, or at least about 400 contiguous amino acids of SEQ ID NO: 730.

In certain instances, compositions comprise an effector protein and an engineered guide nucleic acid, wherein the amino acid sequence of the effector protein, other than the amino acid alteration at position 468, is at least 65%, at least 70%, at least 75%, at least 80%, at least 85%, at least 90%, at least 95%, at least 97%, or at least 98%, at least 99%, or 100% identical to SEQ ID NO: 731. In certain instances, compositions comprise an effector protein and an engineered guide nucleic acid, wherein the amino acid sequence of the effector protein, other than the amino acid alteration at position 468, comprises at least about 200, at least about 220, at least about 240, at least about 260, at least about 280, at least about 300, at least about 320, at least about 340, at least about 360, at least about 380, or at least about 400 contiguous amino acids of SEQ ID NO: 731.

In some embodiments, effector proteins provided herein are a variant of a reference polypeptide, wherein the reference polypeptide has an amino acid sequence of SEQ ID NO: 23, and the effector protein comprises one or more amino acid alterations. In some embodiments, effector proteins provided herein are a variant of a reference polypeptide, wherein the reference polypeptide has an amino acid sequence of SEQ ID NO: 23, and the effector protein comprises one or more conservative or non-conservative amino acid alterations. In some embodiments, effector proteins provided herein are a variant of a reference polypeptide, wherein the reference polypeptide has an amino acid sequence of SEQ ID NO: 23, and the effector protein comprises one or more amino acid alterations comprising substitutions, deletions, insertions, or any combination thereof. In some embodiments, effector proteins provided herein are a variant of a reference polypeptide, wherein the reference polypeptide has an amino acid sequence of SEQ ID NO: 23, and the effector protein comprises one or more amino acid alterations that are conservative amino acid alterations. In some embodiments, effector proteins provided herein are a variant of a reference polypeptide, wherein the reference polypeptide has an amino acid sequence of SEQ ID NO: 23, and the effector protein comprises one or more amino acid alterations that are non-conservative amino acid alterations.

In some instances, an effector protein disclosed herein comprises an amino acid sequence that is at least about 80%, at least about 85%, at least about 90%, at least about 95%, at least about 98%, at least about 99%, or about 100% identical to SEQ ID NO: 23 and comprises at least one amino acid alteration relative to SEQ ID NO: 23. In some instances, an effector protein disclosed herein comprises an amino acid sequence that is at least about 80%, at least about 85%, at least about 90%, at least about 95%, at least about 98%, at least about 99%, or about 100% identical to SEQ ID NO: 23 and comprises at least one conservative amino acid alteration relative to SEQ ID NO: 23. In some instances, an effector protein disclosed herein comprises an amino acid sequence that is at least about 80%, at least about 85%, at least about 90%, at least about 95%, at least about 98%, at least about 99%, or about 100% identical to identical to SEQ ID NO: 23 and comprises at least one non-conservative amino acid alteration relative to SEQ ID NO: 23. In some instances, an effector protein disclosed herein comprises an amino acid sequence that is at least about 80%, at least about 85%, at least about 90%, at least about 95%, at least about 98%, at least about 99%, or about 100% identical to SEQ ID NO: 23, wherein all but 1, 2, 3, 4, 5, 6, 7, 8, 9 or 10 amino acids alterations relative to SEQ ID NO: 23 are conservative amino acid substitutions. In some instances, an effector protein disclosed herein comprises an amino acid sequence that is at least about 80%, at least about 85%, at least about 90%, at least about 95%, at least about 98%, at least about 99%, or about 100% identical to SEQ ID NO: 23, wherein all but 1, 2, 3, 4, 5, 6, 7, 8, 9 or 10 amino acids alterations relative to SEQ ID NO: 23 are non-conservative amino acid substitutions. In some instances, an effector protein disclosed herein comprises an amino acid sequence that is identical to SEQ ID NO: 23 with the exception of 1, 2, 3, 4, 5, 6, 7, 8, 9 or 10 conservative amino acid alterations. In some instances, an effector protein disclosed herein comprises an amino acid sequence that is identical to SEQ ID NO: 23 with the exception of 1, 2, 3, 4, 5, 6, 7, 8, 9 or 10 non-conservative amino acid alterations.

In some embodiments, the D2S effector protein comprises one or more amino acid alteration in a domain of the D2S effector protein, wherein the D2S effector protein comprises a RuvC domain, a REC domain, or a zinc finger domain, or any combination thereof. In certain embodiments, the RuvC domain comprises RuvC-I, RuvC-II, RuvC-III subdomains, or any combination thereof. In certain embodiments, the D2S effector protein comprises one or more amino acid alteration in a RuvC subdomain, or the REC domain. In certain embodiments, the D2S effector protein comprises one or more amino acid alteration in the RuvC-I subdomain, the RuvC-II subdomain, or the REC domain. In certain embodiments, the D2S effector protein comprises one or more amino acid alteration in the RuvC-I subdomain. In certain embodiments, the D2S effector protein comprises one or more amino acid alteration in the RuvC-II subdomain. In certain embodiments, the D2S effector protein comprises one or more amino acid alteration in the REC domain. In certain embodiments, the D2S effector protein comprises one or more amino acid alteration in a domain of SEQ ID NO: 23. In certain embodiments, the D2S effector protein comprises one or more amino acid alteration in the RuvC-I subdomain, the RuvC-II subdomain, or the REC domain of SEQ ID NO: 23.

In some embodiments, the D2S effector protein comprises one or more amino acid alteration at a position corresponding to the residue at 110, 111, 112, 113, 114, 115, 116, 117, 118, 119, 122, 123, 124, 125, 126, 127, 128, 129, 130, 131, 132, or any combination thereof in the REC domain of SEQ ID NO: 23. In some embodiments, the D2S effector protein comprises one or more amino acid alteration at a position corresponding to the residue at 261, 263, 264, 265, 266, 267, 268, 269, 270, 271, 272, 273, 274, 275, 276, 277, 278, 279, 280, 281, 282, or any combination thereof in the RuvC-I domain of SEQ ID NO: 23. In some embodiments, the D2S effector protein comprises one or more amino acid alteration at a position corresponding to the residue at 457, 458, 459, 460, 461, 462, 463, 464, 466, 467, 468, or any combination thereof in the RuvC-II domain of SEQ ID NO: 23. In some embodiments, the amino acid alteration is an arginine substitution.

In some embodiments, the D2S effector protein comprises one or more amino acid alteration T115R, T124R, L126R, E127R, T128R, N129R, A132R, or any combination thereof in a REC domain of SEQ ID NO: 23. In some embodiments, the D2S effector protein comprises one or more amino acid alteration K261R, V263R, T278R, T281R, E282R, or any combination thereof in a RuvC-I domain of SEQ ID NO: 23. In some embodiments, the D2S effector protein comprises one or more amino acid alteration N459R, S460R, D462R, K466R, N467R, E468R, or any combination thereof in a RuvC-II domain of SEQ ID NO: 23. In some embodiments, the D2S effector protein comprises one or more amino acid alteration at a position corresponding to one or more residue D267A, E363Q, or any combination thereof. In some embodiments, the D2S effector protein comprises one or more amino acid alteration at a position corresponding to one or more residue D267N, E363Q, or any combination thereof.

In some embodiments, to provide a D2S effector protein variant, a D2S effector protein disclosed herein is selected as a template or parent sequence. Variants can be created by introducing one or more amino acid alteration (e.g., a substitution) into the template or parent sequence. The variants can be screened to identify those that have increased activity and/or specificity for their substrates. For example, a D2S effector protein variant is screened to identify those alterations leading to increased activity or specificity for the parent D2S effector protein's substrate or substrates.

For the purpose of amino acid position numbering, in some embodiments, SEQ ID NO: 23 is used as the reference sequence. Therefore, for example, mention of amino acid position 278 in reference to SEQ ID NO: 23, but in the context of a variant sequence, the corresponding amino acid position for variant creation may have the same or different position number, (e.g., 277, 278, or 279). In some cases, the original amino acid and its position on the SEQ ID NO: 23 reference sequence will precisely correlate with the amino acid and position on the variant sequence. In other cases, the original amino acid and its position on the SEQ ID NO: 23 reference sequence will correlate with the original amino acid, but its position on the variant will not be in the corresponding template position. However, the corresponding amino acid on the variant can be a predetermined distance from the position on the template, such as within 10, 9, 8, 7, 6, 5, 4, 3, 2, or 1 amino acid positions from the reference template position. In other cases, the original amino acid on the SEQ ID NO: 23 reference sequence will not precisely correlate with the amino acid on the variant. However, one can understand what the corresponding amino acid on the variant sequence is based on the general location of the amino acid on the template and the sequence of amino acids in the vicinity of the variant amino acid.

In certain instances, a variant D2S effector protein has an increased nuclease activity as compared to the nuclease activity of the corresponding parent sequence of SEQ ID NO: 23. In some embodiments, a variant D2S effector protein has a nuclease activity that is at least 0.25 fold, at least 0.5 fold, at least 0.75 fold, at least 1 fold, at least 1.25 fold, 1.5 fold, at least 2 fold, at least 5 fold, at least 10 fold, at least 25 fold, or 0.25-25 fold as compared to the nuclease activity of the corresponding parent sequence of SEQ ID NO: 23.

An effector protein may be small, which may be beneficial for nucleic acid detection or editing (for example, the effector protein may be less likely to adsorb to a surface or another biological species due to its small size). The smaller nature of these effector proteins may allow for them to be more easily packaged and delivered with higher efficiency in the context of genome editing and more readily incorporated as a reagent in an assay. In some instances, the length of the effector protein is less than 400 amino acids. In some instances, the length of the effector protein is at least 368 amino acids. In some instances, the length of the effector protein is 368 to 378, 368 to 398, or 368 to 400 amino acids. In some instances, the length of the effector protein is at least 400 linked amino acid residues. In some instances, the length of the effector protein is less than 500 linked amino acid residues. In some instances, the length of the effector protein is about 400 to about 500 linked amino acid residues. In some instances, the length of the effector protein is about 380 to about 850 linked amino acid residues. In some instances, the length of the effector protein is about 300 to about 700 linked amino acid residues. In some instances, the length of the effector protein is about 450 to about 550, about 330 to about 600, about 380 to about 500, about 400 to about 420, about 420 to about 440, about 440 to about 460, about 460 to about 480, about 480 to about 500, about 500 to about 520, about 520 to about 540, about 540 to about 560, about 560 to about 580, about 580 to about 600, about 600 to about 620, about 620 to about 640, about 640 to about 660, about 660 to about 680, about 680 to about 700 linked amino acids. In some cases, a linked amino acids comprises at least two amino acids linked by an amide bond.

In some instances, the effector proteins function as an endonuclease that catalyzes cleavage within a target nucleic acid. In some instances, the effector proteins are capable of catalyzing non-sequence-specific cleavage of a single stranded nucleic acid. In some instances, the effector proteins (e.g., the effector proteins having SEQ ID NOs: 1-45, 202-293) are activated to perform trans cleavage activity after binding of a guide nucleic acid with a target nucleic acid. This trans cleavage activity may also be referred to as "collateral" or "transcollateral" cleavage. Trans cleavage activity may be non-specific cleavage of nearby single-stranded nucleic acid by the activated effector protein, such as trans cleavage of detector nucleic acids with a detection moiety.

Effector proteins disclosed herein may function as an endonuclease that catalyzes cleavage at a specific position (e.g., at a specific nucleotide within a nucleic acid sequence) in a target nucleic acid. The target nucleic acid may be single stranded RNA (ssRNA), double stranded DNA (dsDNA) or single-stranded DNA (ssDNA). In some instances, the target nucleic acid is single-stranded DNA. In some instances, the target nucleic acid is single-stranded RNA. The effector proteins may provide cis cleavage activity, trans cleavage activity, nickase activity, or a combination thereof. Cis cleavage activity is cleavage of a target nucleic acid that is hybridized to a guide RNA (e.g., a dual gRNA or a sgRNA), wherein cleavage occurs within or directly adjacent to the region of the target nucleic acid that is hybridized to guide RNA. Trans cleavage activity (also referred to as transcollateral cleavage) is cleavage of ssDNA or ssRNA that is near, but not hybridized to the guide RNA. Trans cleavage activity is triggered by the hybridization of guide RNA to the target nucleic acid. Nickase activity is a selective cleavage of one strand of a dsDNA. While certain effector proteins may be used to edit and detect nucleic acids in a sequence specific manner, challenging biological sample conditions (e.g., high viscosity, metal chelating) may limit their accuracy and effectiveness. There is thus a need for systems and methods that employ effector proteins having specificity and efficiency across a wide range of sample conditions.

Effector proteins of the present disclosure, dimers thereof, and multimeric complexes thereof may cleave or nick a target nucleic acid within or near a protospacer adjacent motif (PAM) sequence of the target nucleic acid. In some embodiments, a PAM is a nucleotide sequence found in a target nucleic acid that directs an effector protein to modify the target nucleic acid at a specific location. In some cases, a PAM sequence may be required for a complex having an effector protein and a guide nucleic acid to hybridize to and modify the target nucleic acid. However, a given effector protein may not require a PAM sequence being present in a target nucleic acid for the effector protein to modify the target nucleic acid. In some instances, cleavage occurs within 1, 2, 3, 4, 5, 6, 7, 8, 9 or 10 nucleosides of a 5' or 3' terminus of a PAM sequence. A target nucleic acid may comprise a PAM sequence adjacent to a sequence that is complementary to a guide nucleic acid spacer region. In some instances, the effector protein recognizes a PAM as shown in TABLE 6. In some instances, a composition comprising an effector protein recognizes a PAM sequence comprising any of the following nucleotide sequences: CTT (SEQ ID NO: 154), CC (SEQ ID NO: 155), TCG (SEQ ID NO: 156), GCG (SEQ ID NO: 157), TTG (SEQ ID NO: 158), GTG (SEQ ID NO: 159), ATTA (SEQ ID NO: 160), ATTG (SEQ ID NO: 161), GTTA (SEQ ID NO: 162), GTTG (SEQ ID NO: 163), TC (SEQ ID NO: 164), ACTG (SEQ ID NO: 165), GCTG (SEQ ID NO: 166), TTC (SEQ ID NO: 167), or TTT (SEQ ID NO: 168) as shown in TABLE 6. In some instances, the effector protein recognizes a PAM set forth in FIG. 1.

In some instances, the effector protein recognizes a PAM as shown in TABLE 13. In some instances, the effector protein recognizes a PAM as shown in TABLE 14. In some instances, the effector protein recognizes a PAM as shown in TABLE 16. In some instances, the effector protein recognizes a PAM as shown in TABLE 17. In some instances, the effector protein recognizes a PAM as shown in TABLE 20. In some instances, the effector protein recognizes a PAM as shown in TABLE 21. In some instances, the effector protein recognizes a PAM as shown in TABLE 22. In some instances, the effector protein recognizes a PAM as shown in TABLE 23. In some instances, the PAM sequence comprises a sequence listed in TABLE 24. In some instances, the PAM sequence comprises a sequence listed in TABLE 35. In some instances, the effector protein recognizes a PAM set forth in FIGS. 7A-7E. In some instances, the effector protein recognizes a PAM of SEQ ID NOs: 368, 369, 370, 371. In some instances, the effector protein recognizes a PAM of SEQ ID NOs: 304, 312, 313, 315, 324 or 335. In some instances, the effector protein recognizes a PAM of SEQ ID NOs: 301, 318, 335, 343, 360, or 365. In some instances, the effector protein recognizes a PAM of SEQ ID NOs: 368. In some instances, the effector protein recognizes a PAM of SEQ ID NOs: 343. In some instances, the effector protein recognizes a PAM of SEQ ID NOs: 325, 326, 327, or 328. In some embodiments, effector proteins do not require a PAM sequence to cleave or a nick a target nucleic acid.

In some instances, the effector protein comprises six amino acid sequences selected from the group comprising: (i) an amino acid sequence that is at least 60%, at least 70%, at least 80%, at least 90%, at least 95%, at least 98%, at least 99% or 100% identical to SEQ ID NO: 793 (shown in Table 32), (ii) an amino acid sequence that is at least 60%, at least 70%, at least 80%, at least 90%, at least 95%, at least 98%, at least 99% or 100% identical to SEQ ID NO: 794 (shown in Table 32), (iii) an amino acid sequence that is at least 60%, at least 70%, at least 80%, at least 90%, at least 95%, at least 98%, at least 99% or 100% identical to SEQ ID NO: 795 (shown in Table 32), (iv) an amino acid sequence that is at least 60%, at least 70%, at least 80%, at least 90%, at least 95%, at least 98%, at least 99% or 100% identical to SEQ ID NO: 796 (shown in Table 32), (v) an amino acid sequence that is at least 60%, at least 70%, at least 80%, at least 90%, at least 95%, at least 98%, at least 99% or 100% identical to SEQ ID NO: 797 (shown in Table 32), (vi) an amino acid sequence that is at least 60%, at least 70%, at least 80%, at least 90%, at least 95%, at least 98%, at least 99% or 100% identical to SEQ ID NO: 798 (shown in Table 32), and (vii) an amino acid sequence that is at least 60%, at least 70%, at least 80%, at least 90%, at least 95%, at least 98%, at least 99% or 100% identical to SEQ ID NO: 799 (shown in Table 32).

MEME_1 to MEME_7 are PROSITE motifs, a format which is routinely used in the art to describe a consensus sequence. For example, the PROSITE sequence [NH]AD corresponds to the sequences NAD and HAD. When an amino acid sequence is analysed to calculate the degree of identity to the PROSITE sequence [NH]AD, both NAD and HAD are given equal weight. In other words, both NAD and HAD share 100% identity with the PROSITE motif [NH]AD.

In some instances, the effector protein comprises seven amino acid sequences selected from the group: (i) an amino acid sequence that is at least 40%, at least 50%, at least 60%, at least 70%, at least 80%, at least 90%, at least 95%, at least 98%, at least 99% or 100% identical to SEQ ID NO: 793, (ii) an amino acid sequence that is at least 40%, at least 50%, at least 60%, at least 70%, at least 80%, at least 90%, at least 95%, at least 98%, at least 99% or 100% identical to SEQ ID NO: 794, (iii) an amino acid sequence that is at least 40%, at least 50%, at least 60%, at least 70%, at least 80%, at least 90%, at least 95%, at least 98%, at least 99% or 100% identical to SEQ ID NO: 795, (iv) an amino acid sequence that is at least 40%, at least 50%, at least 60%, at least 70%, at least 80%, at least 90%, at least 95%, at least 98%, at least 99% or 100% identical to SEQ ID NO: 796, (v) an amino acid sequence that is at least 40%, at least 50%, at least 60%, at least 70%, at least 80%, at least 90%, at least 95%, at least 98%, at least 99% or 100% identical to SEQ ID NO: 797, (vi) an amino acid sequence that is at least 40%, at least 50%, at least 60%, at least 70%, at least 80%, at least 90%, at least 95%, at least 98%, at least 99% or 100% identical to SEQ ID NO: 798, and (vii) an amino acid sequence that is at least 40%, at least 50%, at least 60%, at least 70%, at least 80%, at least 90%, at least 95%, at least 98%, at least 99% or 100% identical to SEQ ID NO: 799.

In preferred embodiments, the effector protein comprises six amino acid sequences selected from the group: (i) an amino acid sequence that is at least 69.5% identical to SEQ ID NO: 793, (ii) an amino acid sequence that is at least 69.5% identical to SEQ ID NO: 794, (iii) an amino acid sequence that is at least 69.5% identical to SEQ ID NO: 795, (iv) an amino acid sequence that is at least 69.5% identical to SEQ ID NO: 796, (v) an amino acid sequence that is at least 69.5% identical to SEQ ID NO: 797, (vi) an amino acid sequence that is at least 69.5% identical to SEQ ID NO: 798, and (vii) an amino acid sequence that is at least 69.5% identical to SEQ ID NO: 799. In further preferred embodiments, the effector protein comprises six amino acid sequences selected from the group: (i) an amino acid sequence that is at least 80% identical to SEQ ID NO: 793, (ii) an amino acid sequence that is at least 80% identical to SEQ ID NO: 794, (iii) an amino acid sequence that is at least 80% identical to SEQ ID NO: 795, (iv) an amino acid sequence that is at least 80% identical to SEQ ID NO: 796, (v) an amino acid sequence that is at least 80% identical to SEQ ID NO: 797, (vi) an amino acid sequence that is at least 80% identical to SEQ ID NO: 798, and (vii) an amino acid sequence that is at least 80% identical to SEQ ID NO: 799.

In some instances, the effector protein comprises an amino acid sequence that is (1) at least 50%, at least 60%, at least 70%, at least 75%, at least 80%, at least 85%, at least 90%, at least 95%, at least 98%, at least 99% or 100% identical to SEQ ID NO: 23, preferably at least 68% identical to SEQ ID NO: 23, and (2) includes six amino acid sequences selected from the group: (i) an amino acid sequence that is at 69.5% identical to SEQ ID NO: 793, (ii) an amino acid sequence that is at 69.5% identical to SEQ ID NO: 794, (iii) an amino acid sequence that is at 69.5% identical to SEQ ID NO: 795, (iv) an amino acid sequence that is at 69.5% identical to SEQ ID NO: 796, (v) an amino acid sequence that is at 69.5% identical to SEQ ID NO: 797, (vi) an amino acid sequence that is at 69.5% identical to SEQ ID NO: 798, and (vii) an amino acid sequence that is at 69.5% identical to SEQ ID NO: 799.

In some instances, the effector protein comprises an amino acid sequence that is (1) at least 50%, at least 60%, at least 70%, at least 75%, at least 80%, at least 85%, at least 90%, at least 95%, at least 98%, at least 99% or 100% identical to SEQ ID NO: 23 and (2) includes six amino acid sequences selected from the group comprising: (i) an amino acid sequence that is at least 60%, at least 70%, at least 80%, at least 90%, at least 95%, at least 98%, at least 99% or 100% identical to SEQ ID NO: 793, (ii) an amino acid sequence that is at least 60%, at least 70%, at least 80%, at least 90%, at least 95%, at least 98%, at least 99% or 100% identical to SEQ ID NO: 794, (iii) an amino acid sequence that is at least 60%, at least 70%, at least 80%, at least 90%, at least 95%, at least 98%, at least 99% or 100% identical to SEQ ID NO: 795, (iv) an amino acid sequence that is at least 60%, at least 70%, at least 80%, at least 90%, at least 95%, at least 98%, at least 99% or 100% identical to SEQ ID NO: 796, (v) an amino acid sequence that is at least 60%, at least 70%, at least 80%, at least 90%, at least 95%, at least 98%, at least 99% or 100% identical to SEQ ID NO: 797, (vi) an amino acid sequence that is at least 60%, at least 70%, at least 80%, at least 90%, at least 95%, at least 98%, at least 99% or 100% identical to SEQ ID NO: 798, and (vii) an amino acid sequence that is at least 60%, at least 70%, at least 80%, at least 90%, at least 95%, at least 98%, at least 99% or 100% identical to SEQ ID NO: 799.

In some preferred embodiments, the effector protein comprises an amino acid sequence that is (1) at least 68% identical to SEQ ID NO:23, and (2) includes six amino acid sequences selected from the group: (i) an amino acid sequence that is at least 69.5% identical to SEQ ID NO: 793, (ii) an amino acid sequence that is at least 69.5% identical to SEQ ID NO: 794, (iii) an amino acid sequence that is at least 69.5% identical to SEQ ID NO: 795, (iv) an amino acid sequence that is at least 69.5% identical to SEQ ID NO: 796, (v) an amino acid sequence that is at least 69.5% identical to SEQ ID NO: 797, (vi) an amino acid sequence that is at least 69.5% identical to SEQ ID NO: 798, and (vii) an amino acid sequence that is at least 69.5% identical to SEQ ID NO: 799.

In some instances, the effector protein comprises an amino acid sequence that is at least 37%, at least 40%, at least 50%, at least 60%, at least 70%, at least 80%, at least 90%, at least 95%, at least 98%, at least 99% or 100% identical to SEQ ID NO: 796.

In some instances, the effector protein comprises (1) an amino acid sequence that is at least 37%, at least 40%, at least 50%, at least 60%, at least 70%, at least 80%, at least 90%, at least 95%, at least 98%, at least 99% or 100% identical to SEQ ID NO: 796, and (2) four amino acid sequences selected from the group: (i) an amino acid sequence that is at least 60%, at least 70%, at least 80%, at least 90%, at least 95%, at least 98%, at least 99% or 100% identical to SEQ ID NO: 793, (ii) an amino acid sequence that is at least 60%, at least 70%, at least 80%, at least 90%, at least 95%, at least 98%, at least 99% or 100% identical to SEQ ID NO: 794, (iii) an amino acid sequence that is at least 60%, at least 70%, at least 80%, at least 90%, at least 95%, at least 98%, at least 99% or 100% identical to SEQ ID NO: 795, (iv) an amino acid sequence that is at least 60%, at least 70%, at least 80%, at least 90%, at least 95%, at least 98%, at least 99% or 100% identical to SEQ ID NO: 797, (v) an amino acid sequence that is at least 60%, at least 70%, at least 80%, at least 90%, at least 95%, at least 98%, at least 99% or 100% identical to SEQ ID NO: 798, and (vi) an amino acid sequence that is at least 60%, at least 70%, at least 80%, at least 90%, at least 95%, at least 98%, at least 99% or 100% identical to SEQ ID NO: 799. In some further instances, the effector protein comprises an amino acid sequence that is at least 50%, at least 60%, at least 70%, at least 75%, at least 80%, at least 85%, at least 90%, at least 95%, at least 98%, at least 99% or 100% identical to SEQ ID NO: 23, preferably wherein the amino acid sequence is at least 68% identical to SEQ ID NO:23.

In some instances, the effector protein comprises (1) an amino acid sequence that is at least 37%, at least 40%, at least 50%, at least 60%, at least 70%, at least 80%, at least 90%, at least 95%, at least 98%, at least 99% or 100% identical to SEQ ID NO: 796, and (2) four amino acid sequences selected from the group: (i) an amino acid sequence that is at least 69.5% identical to SEQ ID NO: 793, (ii) an amino acid sequence that is at least 69.5% identical to SEQ ID NO: 794, (iii) an amino acid sequence that is at least 69.5% identical to SEQ ID NO: 795, (iv) an amino acid sequence that is at least 69.5% identical to SEQ ID NO: 797, (v) an amino acid sequence that is at least 69.5% identical to SEQ ID NO: 798, and (vi) an amino acid sequence that is at least 69.5% identical to SEQ ID NO: 799. In some further instances, the effector protein comprises an amino acid sequence that is at least 50%, at least 60%, at least 70%, at least 75%, at least 80%, at least 85%, at least 90%, at least 95%, at least 98%, at least 99% or 100% identical to SEQ ID NO: 23, preferably wherein the amino acid sequence is at least 68% identical to SEQ ID NO:23.

In some instances, the effector protein comprises one or more of: (i) an amino acid sequence that is at least 80%, preferably at least 90%, identical to SEQ ID NO: 793, (ii) an amino acid sequence that is at least 80%, preferably at least 90%, identical to SEQ ID NO: 794, (iii) an amino acid sequence that is at least 80%, preferably at least 90%, identical to SEQ ID NO: 795, (iv) an amino acid sequence that is at least 80%, preferably at least 90%, identical to SEQ ID NO: 796, (v) an amino acid sequence that is at least 80%, preferably at least 90%, identical to SEQ ID NO: 797, (vi) an amino acid sequence that is at least 80%, preferably at least 90%, identical to SEQ ID NO: 798, and (vii) an amino acid sequence that is at least 80%, preferably at least 90%, identical to SEQ ID NO: 799.

In some instances, the effector proteins comprises amino acid sequences that have at least a threshold identity referred to herein to any one of SEQ ID NO: 793 to SEQ ID NO: 799 and the amino acid sequences are in the following order, starting from the N-terminus: (i) the sequence having at least the threshold identity with SEQ ID NO: 796, (ii) the sequence having at least the threshold identity with SEQ ID NO: 797, (iii) the sequence having at least the threshold identity with SEQ ID NO: 795, (iv) the sequence having at least the threshold identity with SEQ ID NO: 799, (v) the sequence having at least the threshold identity with SEQ ID NO: 794, (vi) the sequence having at least the threshold identity with SEQ ID NO: 793, and (vii) the sequence having at least the threshold identity with SEQ ID NO: 798. In some instances, the effector protein does not include an amino acid that meets a specified degree of identity (i.e. the threshold identity) with any one of SEQ ID NO: 793 to SEQ ID NO: 799. For example, in some instances, the effector protein does not include an amino acid sequence having 36.5% or more identity with SEQ ID NO: 796, and the effector protein comprises, distributed through the protein starting from the N-terminus, (i) a sequence having at least the threshold identity with SEQ ID NO: 797, (ii) a sequence having at least the threshold identity with SEQ ID NO: 795, (iii) a sequence having at least the threshold identity with SEQ ID NO: 799, (iv) a sequence having at least the threshold identity with SEQ ID NO: 794, (v) a sequence having at least the threshold identity with SEQ ID NO: 793, and (vi) a sequence having at least the threshold identity with SEQ ID NO: 798.

In some instances, effector proteins have been modified. In some embodiments, D2S effector proteins disclosed herein or a variant thereof may comprise an NLS. In some cases, an NLS comprises an entity (e.g., peptide) that facilitates localization of a nucleic acid, protein, or small molecule to the nucleus, when present in a cell that contains a nuclear compartment. An NLS can be located at or near the amino terminus (N-terminus) of the D2S effector proteins disclosed herein. An NLS can be located at or near the carboxy terminus (C-terminus) of the D2S effector proteins disclosed herein. In some embodiments, a vector encodes the D2S effector proteins described herein, wherein the vector or vector systems disclosed herein comprises one or more NLSs, such as about or more than about 1, 2, 3, 4, 5, 6, 7, 8, 9, 10, or more NLSs. In some embodiments, a D2S effector protein described herein comprises 1, 2, 3, 4, 5, 6, 7, 8, 9, 10, or more NLSs at or near the N-terminus, 1, 2, 3, 4, 5, 6, 7, 8, 9, 10, or more NLSs at or near the C-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus.

In certain embodiments, the nucleotide sequence encoding the effector protein is codon optimized (e.g., for expression in a eukaryotic cell) relative to the naturally occurring sequence. In some embodiments, D2S effector proteins described herein are encoded by a codon optimized nucleic acid. In some embodiments, a nucleic acid sequence encoding a D2S effector protein described herein is codon optimized. This type of optimization can entail a mutation of a D2S effector protein encoding nucleotide sequence to mimic the codon preferences of the intended host organism or cell while encoding the same polypeptide. Thus, the codons can be changed, but the encoded protein remains unchanged. For example, if the intended target cell was a human cell, a human codon-optimized D2S effector protein-encoding nucleotide sequence could be used. As another non-limiting example, if the intended host cell were a mouse cell, then a mouse codon-optimized D2S effector protein-encoding nucleotide sequence could be generated. As another non-limiting example, if the intended host cell were a eukaryotic cell, then a eukaryote codon-optimized D2S effector protein nucleotide sequence could be generated. As another non-limiting example, if the intended host cell were a prokaryotic cell, then a prokaryote codon-optimized D2S effector protein-encoding nucleotide sequence could be generated. Codon usage tables are readily available, for example, at the "Codon Usage Database" available at kazusa.or.jp/codon. Effector proteins may be codon optimized for expression in a specific cell, for example, a bacterial cell, a plant cell, a eukaryotic cell, an animal cell, a mammalian cell, or a human cell. In some embodiments, the effector protein is codon optimized for a human cell.

It is understood that when describing coding sequences of polypeptides described herein, said coding sequences do not necessarily require a codon encoding a N-terminal Methionine (M) or a Valine (V) as described for the D2S effector proteins described herein. One skilled in the art would understand that a start codon could be replaced or substituted with a start codon that encodes for an amino acid residue sufficient for initiating translation in a host cell. In some instances, when a modifying heterologous peptide, such as a fusion protein partner is located at the N terminus of the effector protein, a start codon for the fusion protein partner serves as a start codon for the effector protein as well. Thus, the natural start codon encoding an amino acid residue sufficient for initiating translation (e.g., Methionine (M) or a Valine (V)) of the effector protein may be removed or absent.

In some cases, compositions comprise a D2S effector protein and a cell. In some embodiments, compositions comprise a cell that expresses a D2S effector protein. In some cases, compositions comprise a nucleic acid encoding a D2S effector protein and a cell. In some embodiments, compositions comprise a cell expressing a nucleic acid encoding a D2S effector protein. In some instances, the cell is a prokaryotic cell. In some instances, the cell is a eukaryotic cell. In some instances, the cell is a mammalian cell.

D2S effector proteins of the present disclosure may be produced in vitro or by eukaryotic cells or by prokaryotic cells. D2S effector proteins can be further processed by unfolding, e.g. heat denaturation, dithiothreitol reduction, etc. and may be further refolded, using any suitable method. D2S effector proteins of the present disclosure of the present disclosure may be synthesized, using any suitable method.

In some embodiments, D2S effector proteins described herein can be isolated and purified for use in compositions, systems, and/or methods described herein. Methods described here can include the step of isolating D2S effector proteins described herein. Compositions and/or systems described herein can further comprise a purification tag that can be attached to a D2S effector protein, or a nucleic acid encoding for a purification tag that can be attached to a nucleic acid encoding for a D2S effector protein as described herein. A purification tag, as used herein, can be an amino acid sequence which can attach or bind with high affinity to a separation substrate and assist in isolating the protein of interest from its environment, which can be its biological source, such as a cell lysate. Attachment of the purification tag can be at the N or C terminus of the D2S effector protein. In some instances when a purification tag located at the N terminus of the effector protein, a start codon for the purification tag serves as a start codon for the effector protein as well. Thus, the natural start codon of the effector protein may be removed or absent. Furthermore, an amino acid sequence recognized by a protease or a nucleic acid encoding for an amino acid sequence recognized by a protease, such as TEV protease or the HRV3C protease can be inserted between the purification tag and the D2S effector protein, such that biochemical cleavage of the sequence with the protease after initial purification liberates the purification tag. Purification and/or isolation can be through high performance liquid chromatography (HPLC), exclusion chromatography, gel electrophoresis, affinity chromatography, or other purification technique. Non-limiting examples of purification tags include a histidine tag, e.g., a 6×His tag (SEQ ID NO: 944); a hemagglutinin (HA) tag; a FLAG tag; a Myc tag; and maltose binding protein (MBP). In some embodiments, an effector protein is fused or linked (e.g., via an amide bond) to a fluorescent protein. Non-limiting examples of fluorescent proteins include green fluorescent protein (GFP), yellow fluorescent protein (YFP), red fluorescent protein (RFP), cyan fluorescent protein (CFP), mCherry, and tdTomato.

For example, in some embodiments, D2S effector proteins described herein are isolated from cell lysate. In some embodiments, the compositions described herein can comprise 20% or more by weight, 75% or more by weight, 95% or more by weight, or 99.5% or more by weight of a D2S effector protein, related to the method of preparation of compositions described herein and its purification thereof, wherein percentages can be upon total protein content in relation to contaminants. Thus, in some cases, a D2S effector protein described herein is at least 80% pure, at least 85% pure, at least 90% pure, at least 95% pure, at least 98% pure, or at least 99% pure (e.g., free of contaminants, non-engineered polypeptide proteins or other macromolecules, etc.).

Engineered Proteins

In some instances, effector proteins disclosed herein are engineered proteins. Engineered proteins are not identical to a naturally-occurring protein. Such an engineered protein can include one or more mutations, including an insertion, deletion or substitution (e.g., conservative or non-conservative substitution). An engineered protein, in some embodiments, includes at least one mutation relative to a reference protein (e.g., a naturally-occurring protein). In some embodiments, an engineered protein includes at least 1, at least 2, at least 3, at least 4, at least 5, at least 6, at least 7, at least 8, at least 9, at least 10, at least 15, at least 20, at least 25 or at least 30 mutations relative to a reference protein (e.g., a naturally-occurring protein). In some embodiments, an engineered protein includes no more than 10, 20, 30, 40, or 50 mutations relative to a reference protein (e.g., a naturally-occurring protein). Engineered proteins may provide enhanced nuclease or nickase activity as compared to a naturally occurring nuclease or nickase. By way of non-limiting example, some engineered proteins exhibit optimal activity at lower salinity and viscosity than the protoplasm of their bacterial cell of origin. Also, by way of non-limiting example, bacteria often comprise protoplasmic salt concentrations greater than 250 mM and room temperature intracellular viscosities above 2 centipoise, whereas engineered proteins exhibit optimal activity (e.g., cis-cleavage activity) at salt concentrations below 150 mM and viscosities below 1.5 centipoise. The present disclosure leverages these dependencies by providing engineered proteins in solutions optimized for their activity and stability.

Compositions and systems described herein may comprise an engineered effector protein in a solution comprising a room temperature viscosity of less than about 15 centipoise, less than about 12 centipoise, less than about 10 centipoise, less than about 8 centipoise, less than about 6 centipoise, less than about 5 centipoise, less than about 4 centipoise, less than about 3 centipoise, less than about 2 centipoise, or less than about 1.5 centipoise.

Compositions and systems may comprise an engineered effector protein in a solution comprising an ionic strength of less than about 500 mM, less than about 400 mM, less than about 300 mM, less than about 250 mM, less than about 200 mM, less than about 150 mM, less than about 100 mM, less than about 80 mM, less than about 60 mM, or less than about 50 mM. Compositions and systems may comprise an engineered effector protein and an assay excipient, which may stabilize a reagent or product, prevent aggregation or precipitation, or enhance or stabilize a detectable signal (e.g., a fluorescent signal). Examples of assay excipients include, but are not limited to, saccharides and saccharide derivatives (e.g., sodium carboxymethyl cellulose and cellulose acetate), detergents, glycols, polyols, esters, buffering agents, alginic acid, and organic solvents (e.g., DMSO).

An engineered protein may comprise a modified form of a wild type counterpart protein (e.g., a D2S effector protein).

The modified form of the wild type counterpart may comprise an amino acid change (e.g., deletion, insertion, or substitution) that reduces the nucleic acid-cleaving activity of the effector protein relative to the wild type counterpart. For example, a nuclease domain (e.g., RuvC domain) of a D2S effector protein may be deleted or mutated relative to a wild type counterpart D2S effector protein so that it is no longer functional or comprises reduced nuclease activity. The modified form of the effector protein may have less than 90%, less than 80%, less than 70%, less than 60%, less than 50%, less than 40%, less than 30%, less than 20%, less than 10%, less than 5%, or less than 1% of the nucleic acid-cleaving activity of the wild-type counterpart. Engineered proteins may have no substantial nucleic acid-cleaving activity. Engineered proteins may be enzymatically inactive or "dead," that is it may bind to a nucleic acid but not cleave it. An enzymatically inactive protein may comprise an enzymatically inactive domain (e.g. inactive nuclease domain). Enzymatically inactive may refer to an activity less than 1%, less than 2%, less than 3%, less than 4%, less than 5%, less than 6%, less than 7%, less than 8%, less than 9%, or less than 10% activity compared to the wild-type counterpart. A dead protein may associate with a guide nucleic acid to activate or repress transcription of a target nucleic acid sequence. In some instances, the enzymatically inactive protein is fused with a protein comprising recombinase activity.

Fusion Proteins

In some instances, an effector protein is a fusion protein, wherein the fusion protein comprises a D2S effector protein and a fusion partner protein. In some instances, the D2S effector protein comprises an amino acid sequence that is at least 70%, at least 75%, at least 80%, at least 85%, at least 90%, at least 95%, or 100% identical to any one of SEQ ID NOs: 1-5. In some instances the amino acid of the D2S effector protein is at least 70%, at least 75%, at least 80%, at least 85%, at least 90%, at least 95%, or 100% identical to any one of SEQ ID NOs: 1-45. In some instances the amino acid of the D2S effector protein is at least 70%, at least 75%, at least 80%, at least 85%, at least 90%, at least 95%, or 100% identical to any one of SEQ ID NOs: 1-45, 202-293, or 728-731. In some instances the amino acid of the D2S effector protein is at least 70%, at least 75%, at least 80%, at least 85%, at least 90%, at least 95%, at least 99%, or 100% identical to any one of SEQ ID NOs: 728-731. Unless otherwise indicated, reference to effector proteins throughout the present disclosure include fusion proteins thereof.

In some embodiments, a fusion effector protein, fusion protein, and fusion polypeptide, comprise a protein comprising at least two heterologous polypeptides. Often a fusion effector protein comprises an effector protein and a fusion partner protein. In general, the fusion partner protein is not an effector protein.

In some embodiments, a fusion partner protein or a fusion partner comprise a protein, polypeptide or peptide that is fused to an effector protein. The fusion partner generally imparts some function to the fusion protein that is not provided by the effector protein. The fusion partner may provide a detectable signal. The fusion partner may modify a target nucleic acid, including changing a nucleobase of the target nucleic acid and making a chemical modification to one or more nucleotides of the target nucleic acid. The fusion partner may be capable of modulating the expression of a target nucleic acid. The fusion partner may inhibit, reduce, activate or increase expression of a target nucleic acid via additional proteins or nucleic acid modifications to the target sequence.

A fusion partner protein is also simply referred to herein as a fusion partner. In some instances, the fusion partner promotes the formation of a multimeric complex of the D2S effector protein. In some instances, the fusion partner inhibits the formation of a multimeric complex of the D2S effector protein. By way of non-limiting example, the fusion protein may comprise a D2S effector protein- and a fusion partner comprising a Calcineurin A tag, wherein the fusion protein dimerizes in the presence of Tacrolimus (FK506). Also by way of non-limiting example, the fusion protein may comprise a D2S effector protein and a SpyTag configured to dimerize or associate with another effector protein in a multimeric complex.

In some instances, the fusion partner is fused to the N-terminus of the effector protein. In some instances, the fusion partner is fused to the C-terminus of the effector protein. The terms "fused" and "linked" are interchangeable.

In some instances, more than one fusion partner is fused to the effector protein. In some instances, a further fusion partner is fused to a first fusion partner that is fused to the effector protein.

In some instances, the fusion partner modulates transcription (e.g., inhibits transcription, increases transcription) of a target nucleic acid. In some instances, the fusion partner is a protein (or a domain from a protein) that inhibits transcription, also referred to as a transcriptional repressor. Transcriptional repressors may inhibit transcription via recruitment of transcription inhibitor proteins, modification of target DNA such as methylation, recruitment of a DNA modifier, modulation of histones associated with target DNA, recruitment of a histone modifier such as those that modify acetylation and/or methylation of histones, or a combination thereof. In some instances, the fusion partner is a protein (or a domain from a protein) that increases transcription, also referred to as a transcription activator. Transcriptional activators may promote transcription via recruitment of transcription activator proteins, modification of target DNA such as demethylation, recruitment of a DNA modifier, modulation of histones associated with target DNA, recruitment of a histone modifier such as those that modify acetylation and/or methylation of histones, or a combination thereof. In some instances, the fusion partner is a reverse transcriptase.

In some instances, the fusion partner is a base editor. In general, a base editor comprises a deaminase that when fused with a D2S protein changes a nucleobase to a different nucleobase, e.g., cytosine to thymine or guanine to adenine. In some instances, the base editor comprises a deaminase.

In some instances, fusion partners provide enzymatic activity that modifies a target nucleic acid. Such enzymatic activities include, but are not limited to, nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity, and glycosylase activity.

Modifying Target Nucleic Acids

In some instances, fusion partners have enzymatic activity that modifies the target nucleic acid. The target nucleic acid may comprise or consist of a ssRNA, dsRNA, ssDNA, or a dsDNA. Examples of enzymatic activity that modifies the target nucleic acid include, but are not limited to: nuclease activity such as that provided by a restriction enzyme (e.g., FokI nuclease); methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants)); demethylase activity such as that provided by a demethylase (e.g., Ten-Eleven Translocation (TET) dioxygenase 1 (TET1CD), TET1, DME, DML1, DML2, ROS1); DNA repair activity; DNA damage (e.g., oxygenation) activity; deamination activity such as that provided by a deaminase (e.g., a cytosine deaminase enzyme such as rat APOBEC1); dismutase activity; alkylation activity; depurination activity; oxidation activity; pyrimidine dimer forming activity; integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase); transposase activity, recombinase activity such as that provided by a recombinase (e.g., catalytic domain of Gin recombinase); as well as polymerase activity, ligase activity, helicase activity, photolyase activity, and glycosylase activity.

Non-limiting examples of fusion partners for targeting ssRNA include, but are not limited to, splicing factors (e.g., RS domains); protein translation components (e.g., translation initiation, elongation, and/or release factors; e.g., eIF4G); RNA methylases; RNA editing enzymes (e.g., RNA deaminases, e.g., adenosine deaminase acting on RNA (ADAR), including A to I and/or C to U editing enzymes); helicases; and RNA-binding proteins. It is understood that a fusion protein may include the entire protein or in some instances may include a fragment of the protein (e.g., a functional domain). In some instances, the functional domain interacts with or binds ssRNA, including intramolecular and/or intermolecular secondary structures thereof, e.g., hairpins, stem-loops, etc.). In some embodiments, a functional domain comprises a region of one or more amino acids in a protein that is required for an activity of the protein, or the full extent of that activity, as measured in an in vitro assay. Activities include, but are not limited to nucleic acid binding, nucleic acid modification, nucleic acid cleavage, protein binding. The absence of the functional domain, including mutations of the functional domain, would abolish or reduce activity. The functional domain may interact transiently or irreversibly, directly or indirectly. Fusion proteins may comprise a protein or domain thereof selected from: endonucleases (e.g., RNase III, the CRR22 DYW domain, Dicer, and PIN (PilT N-terminus); SMG5 and SMG6; domains responsible for stimulating RNA cleavage (e.g., CPSF, CstF, CFIm and CFIIm); exonucleases such as XRN-1 or Exonuclease T; deadenylases such as HNT3; protein domains responsible for nonsense mediated RNA decay (e.g., UPF1, UPF2, UPF3, UPF3b, RNP 51, Y14, DEK, REF2, and SRm160); protein domains responsible for stabilizing RNA (e.g., PABP); proteins and protein domains responsible for repressing translation (e.g., Ago2 and Ago4); proteins and protein domains responsible for stimulating translation (e.g., Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (e.g., PAP1, GLD-2, and Star-PAP); proteins and protein domains responsible for polyuridinylation of RNA (e.g., CI D1 and terminal uridylate transferase); proteins and protein domains responsible for RNA localization (e.g., from IMP1, ZBP1, She2p, She3p, and Bicaudal-D); proteins and protein domains responsible for nuclear retention of RNA (e.g., Rrp6); proteins and protein domains responsible for nuclear export of RNA (e.g., TAP, NXF1, THO, TREX, REF, and Aly); proteins and protein domains responsible for repression of RNA splicing (e.g., PTB, Sam68, and hnRNP A1); proteins and protein domains responsible for stimulation of RNA splicing (e.g., Serine/Arginine-rich (SR) domains); proteins and protein domains responsible for reducing the efficiency of transcription (e.g., FUS (TLS)); and proteins and protein domains responsible for stimulating transcription (e.g., CDK7 and HIV Tat). Alternatively, the effector domain may be a domain of a protein selected from the group comprising endonucleases; proteins and protein domains capable of stimulating RNA cleavage; exonucleases; deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable fusion partner is a PUF RNA-binding domain, which is described in more detail in WO2012068627, which is hereby incorporated by reference in its entirety.

In some instances, the fusion partner comprises an RNA splicing factor. The RNA splicing factor may be used (in whole or as fragments thereof) for modular organization, with separate sequence-specific RNA binding modules and splicing effector domains. Non-limiting examples of RNA splicing factors include members of the Serine/Arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal Glycine-rich domain. Some splicing factors may regulate alternative use of splice site (ss) by binding to regulatory sequences between the two alternative sites. For example, ASF/SF2 may recognize ESEs and promote the use of intron proximal sites, whereas hnRNP A1 may bind to ESSs and shift splicing towards the use of intron distal sites. One application for such factors is to generate ESFs that modulate alternative splicing of endogenous genes, particularly disease associated genes. For example, Bcl-x pre-mRNA produces two splicing isoforms with two alternative 5' splice sites to encode proteins of opposite functions. The long splicing isoform Bcl-xL is a potent apoptosis inhibitor expressed in long-lived postmitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cώ-elements that are located in either the core exon region or the exon extension region (i.e., between the two alternative 5' splice sites). For more examples, see WO2010075303, which is hereby incorporated by reference in its entirety.

In some instances, fusion proteins are targeted by a guide nucleic acid (guide RNA) to a specific location in the target nucleic acid and exert locus-specific regulation such as blocking RNA polymerase binding to a promoter (which selectively inhibits transcription activator function), and/or modifying the local chromatin status (e.g., when a fusion sequence is used that modifies the target nucleic acid or modifies a protein associated with the target nucleic acid). In some instances, the modifications are transient (e.g., transcription repression or activation). In some instances, the modifications are inheritable. For instance, epigenetic modifications made to a target nucleic acid, or to proteins associated with the target nucleic acid, e.g., nucleosomal histones, in a cell, are observed in cells produced by proliferation of the cell.

CRISPRa Fusions and CRISPRi Fusions

In some instances, fusion partners include, but are not limited to, a protein that directly and/or indirectly provides for increased or decreased transcription and/or translation of a target nucleic acid (e.g., a transcription activator or a fragment thereof, a protein or fragment thereof that recruits a transcription activator, a small molecule/drug-responsive transcription and/or translation regulator, a translation-regulating protein, etc.). In some instances, fusion partners that increase or decrease transcription include a transcription activator domain or a transcription repressor domain, respectively.

In some embodiments, fusion partners activate or increase expression of a target nucleic acid. Fusion proteins comprising such fusion partners and a Cas effector protein may be referred to as CRISPRa fusions. In some embodiments, fusion partners increase expression of the target nucleic acid relative to its expression in the absence of the fusion protein. Relative expression, including transcription and RNA levels, may be assessed, quantified, and compared, e.g., by RT-qPCR. In some embodiments, fusion partners comprise a transcriptional activator. Transcriptional activators may promote transcription via: recruitment of other transcription factor proteins; modification of target DNA such as demethylation; recruitment of a DNA modifier; modulation of histones associated with target DNA; recruitment of a histone modifier such as those that modify acetylation and/or methylation of histones; or a combination thereof.

In some cases, a fusion partner that promotes or increases transcription is VPR. In some embodiments, VPR can be fused to a catalytically inactive effector protein. In some embodiments, the amino acid sequence of VPR is DALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKP APQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVD NSEFQQLLNQGIPVAPHTTEPMLMEYPEAITRLVTGAQRPPDPAPAPLGAPGLPNGLLSGDED FSSIADMDFSALLGSGSGSRDSREGMFLPKPEAGSAISDVFEGREVCQPKRIRPFHPPGSPWAN RPLPASLAPTPTGPVHEPVGSLTPAPVPQPLDPAPAVTPEASHLLEDPDEETSQAVKALREMA DTVIPQKEEAAICGQMDLSHPPPRGHLDELTTTLESMTEDLNLDSPLTPELNEILDTFLNDECL LHAMHISTGLSIFDTSLF (SEQ ID NO: 300). In some embodiments, a fusion partner protein comprises an amino acid sequence that is at least 75%, at least 80%, at least 85%, at least 90%, at least 95%, at least 98%, at least 99% or 100% identical to SEQ ID NO: 300.

Non-limiting examples of fusion partners that promote or increase transcription include, but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET1A, SET1B, MLL1 to 5, ASH1, SYMD2, NSD1; histone lysine demethylases such as JHDM2a/b, UTX, JMJD3; histone acetyltransferases such as GCN5, PCAF, CBP, p300, TAF1, TIP60/PLIP, MOZ/MYST3, MORF/MYST4, SRC1, ACTR, P160, CLOCK; and DNA demethylases such as Ten-Eleven Translocation (TET) dioxygenase 1 (TET1CD), TET1, DME, DML1, DML2, and ROS1; and functional domains thereof.

In some embodiments, a target nucleic acid for increased expression comprises NEUROD1, HBG1, ASCL1, LIN28A, or any combination thereof. In some cases, to increase the expression of target, a guide RNA comprises a sequence that is at least 75%, at least 80%, at least 85%, at least 90%, at least 95%, at least 98%, at least 99% or 100% identical to any one of SEQ ID NOs: 647-710.

In some embodiments, fusions partners inhibit or reduce expression of a target nucleic acid. Fusion proteins comprising such fusion partners and an effector protein may be referred to as CRISPRi fusions. In some embodiments, fusion partners reduce expression of the target nucleic acid relative to its expression in the absence of the fusion effector protein. Relative expression, including transcription and RNA levels, may be assessed, quantified, and compared, e.g., by RT-qPCR. In some embodiments, fusion partners may comprise a transcriptional repressor. In some embodiments, a transcriptional repressor can describe a polypeptide or a fragment thereof that is capable of arresting, preventing, or reducing transcription of a target nucleic acid. Transcriptional repressors may inhibit transcription via: recruitment of other transcription factor proteins; modification of target DNA such as methylation; recruitment of a DNA modifier; modulation of histones associated with target DNA; recruitment of a histone modifier such as those that modify acetylation and/or methylation of histones; or a combination thereof.

Non-limiting examples of fusion partners that decrease or inhibit transcription include, but are not limited to: transcriptional repressors such as the Krüppel associated box (KRAB or SKD); KOX1 repression domain; the Mad mSIN3 interaction domain (SID); the ERF repressor domain (ERD), the SRDX repression domain (e.g., for repression in plants); histone lysine methyltransferases such as Pr-SET7/8, SUV4-20H1, RIZ1, and the like; histone lysine demethylases such as JMJD2A/JHDM3A, JMJD2B, JMJD2C/GASC1, JMJD2D, JARID1A/RBP2, JARID1B/PLU-1, JARID1C/SMCX, JARID1D/SMCY; histone lysine deacetylases such as HDAC1, HDAC2, HDAC3, HDAC8, HDAC4, HDAC5, HDAC7, HDAC9, SIRT1, SIRT2, HDAC11; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants); and periphery recruitment elements such as Lamin A, and Lamin B; and functional domains thereof.

In some instances, fusion partners include, but are not limited to, a protein that directly and/or indirectly provides for increased or decreased transcription and/or translation of a target nucleic acid (e.g., a transcription activator or a fragment thereof, a protein or fragment thereof that recruits a transcription activator, a small molecule/drug-responsive transcription and/or translation regulator, a translation-regulating protein, etc.). In some instances, fusion partners that increase or decrease transcription include a transcription activator domain or a transcription repressor domain, respectively.

Base Editors

In some embodiments, fusion partners modify a nucleobase of a target nucleic acid. Fusion proteins comprising such fusion partners and an effector protein may be referred to as base editors. When a base editor is described herein, it can refer to a fusion protein comprising a base editing enzyme fused to an effector protein. The base editor is functional when the effector protein is coupled to a guide nucleic acid. The guide nucleic acid imparts sequence specific activity to the base editor. By way of non-limiting example, the effector protein may comprise a catalytically inactive effector protein. Also, by way of non-limiting example, the base editing enzyme may comprise deaminase activity. Additional base editors are described herein.

In some embodiments, fusion partners modify a nucleobase of a target nucleic acid. Fusion proteins comprising such fusion partners and a Cas effector protein may be referred to as base editors. In some embodiments, base editors modify a sequence of a target nucleic acid. In some embodiments, base editors provide a nucleobase change in a DNA molecule. In some embodiments, the nucleobase change in the DNA molecule is selected from: an adenine (A) to guanine (G); cytosine (C) to thymine (T); and cytosine (C) to guanine (G). In some embodiments, base editors provide a nucleobase change in an RNA molecule. In some embodiments, the nucleobase change in the RNA molecule is selected from: adenine (A) to guanine (G); uracil (U) to cytosine (C); cytosine (C) to guanine (G); and guanine (G) to adenine (A). In some embodiments, the fusion partner is a deaminase, e.g., ADAR1/2.

In some embodiments, a base editor comprises a fusion protein comprising a base editing enzyme fused to an effector protein. The base editor is functional when the effector protein is coupled to a guide nucleic acid. The guide nucleic acid imparts sequence specific activity to the base editor. By way of non-limiting example, the effector protein may comprise a catalytically inactive effector protein. Also, by way of non-limiting example, the base editing enzyme may comprise deaminase activity.

Some base editors modify a nucleobase of on a single strand of DNA. In some embodiments, base editors modify a nucleobase on both strands of dsDNA. In some embodiments, upon binding to its target locus in DNA, base pairing between the guide RNA and target DNA strand leads to displacement of a small segment of single-stranded DNA in an "R-loop". In some embodiments, DNA bases within the R-loop are modified by the deaminase enzyme. In some embodiments, DNA base editors for improved efficiency in eukaryotic cells comprise a catalytically inactive effector protein that may generate a nick in the non-edited DNA strand, inducing repair of the non-edited strand using the edited strand as a template.

Some base editors modify a nucleobase of an RNA. In some embodiments, RNA base editors comprise an adenosine deaminase. In some embodiments, ADAR proteins bind to RNAs and alter their sequence by changing an adenosine into an inosine. In some embodiments, RNA base editors comprise a Cas effector protein that is activated by or binds RNA. Non-limiting examples of Cas effector proteins that are activated by or bind RNA are Cas13 proteins.

In some embodiments, base editors are used to treat a subject having or a subject suspected of having a disease related to a gene of interest. In some embodiments, base editors are useful for treating a disease or a disorder caused by a point mutation in a gene of interest. In some embodiments, compositions comprise a base editor and a guide nucleic acid, wherein the guide nucleic acid directs the base editor to a sequence in a target gene. The target gene may be associated with a disease. In some embodiments, the guide nucleic acid directs that base editor to or near a mutation in the sequence of a target gene. The mutation may be the deletion of one more nucleotides. The mutation may be the addition of one or more nucleotides. The mutation may be the substitution of one or more nucleotides. The mutation may be the insertion, deletion or substitution of a single nucleotide, also referred to as a point mutation. The point mutation may be a SNP. The mutation may be associated with a disease. In some embodiments, the guide nucleic acid directs the base editor to bind a target sequence within the target nucleic acid that is within 0, 1, 2, 3, 4, 5, 6, 7, 8, 9, 10, 11, 12, 13, 14, 15, 16, 17, 18, 19, or 20 nucleotides of the mutation. In some embodiments, the guide nucleic acid comprises a sequence that is identical, complementary or reverse complementary to a target sequence of a target nucleic acid that comprises the mutation. In some embodiments, the guide nucleic acid comprises a sequence that is identical, complementary or reverse complementary to a target sequence of a target nucleic acid that is within 1, 2, 3, 4, 5, 6, 7, 8, 9, 10, 11, 12, 13, 14, 15, 16, 17, 18, 19, or 20 nucleotides of the mutation.

Some base editors modify a nucleobase of an RNA. In some embodiments, RNA base editors comprise an adenosine deaminase. In some embodiments, ADAR proteins bind to RNAs and alter their sequence by changing an adenosine into an inosine. In some embodiments, RNA base editors comprise a Cas effector protein that is activated by or binds RNA. Non-limiting examples of Cas effector proteins that are activated by or bind RNA are Cas13 proteins.

In some embodiments, base editors are used to treat a subject having or a subject suspected of having a disease related to a gene of interest. In some embodiments, base editors are useful for treating a disease or a disorder caused by a point mutation in a gene of interest. In some embodiments, compositions comprise a base editor and a guide nucleic acid, wherein the guide nucleic acid directs the base editor to a sequence in a target gene In some embodiments, fusion partners comprise a base editing enzyme. In some embodiments, the base editing enzyme modifies the nucleobase of a deoxyribonucleotide. In some embodiments, the base editing enzyme modifies the nucleobase of a ribonucleotide. A base editing enzyme that converts a cytosine to a guanine or thymine may be referred to as a cytosine base editing enzyme. A base editing enzyme that converts an adenine to a to a guanine may be referred to as an adenine base editing enzyme. In some embodiments, the base editing enzyme comprises a deaminase enzyme. In some embodiments, the deaminase functions as a monomer. In some embodiments, the deaminase functions as heterodimer with an additional protein. In some embodiments, base editors comprise a DNA glycosylase inhibitor. In some embodiments, base editors comprise a uracil glycosylase inhibitor (UGI) or uracil N-glycosylase (UNG). In some embodiments, base editors do not comprise a UGI. In some embodiments, base editors do not comprise a UNG. In some embodiments, base editors do not comprise a functional fragment of a UGI. A functional fragment of a UGI is a fragment of a UGI that is capable of excising a uracil residue from DNA by cleaving an N-glycosydic bond. In some embodiments, a functional fragment, comprises a fragment of a protein that retains some function relative to the entire protein.

In some embodiments, a base editing enzyme comprises a protein, polypeptide or fragment thereof that is capable of catalyzing the chemical modification of a nucleobase of a deoxyribonucleotide or a ribonucleotide. Such a base editing enzyme, for example, is capable of catalyzing a reaction that modifies a nucleobase that is present in a nucleic acid molecule, such as DNA or RNA (single stranded or double stranded). Non-limiting examples of the type of modification that a base editing enzyme is capable of catalyzing includes converting an existing nucleobase to a different nucleobase, such as converting a cytosine to a guanine or thymine or converting an adenine to a guanine, hydrolytic deamination of an adenine or adenosine, or methylation of cytosine (e.g., CpG, CpA, CpT or CpC). A base editing enzyme itself may or may not bind to the nucleic acid molecule containing the nucleobase.

In some embodiments, the base editor is a cytidine deaminase base editor generated by ancestral sequence reconstruction as described in WO2019226953, which is hereby incorporated by reference in its entirety.

Exemplary deaminase domains are described WO 2018027078 and WO2017070632, and each are hereby incorporated in its entirety by reference. Also, additional exemplary deaminase domains are described in Komor et al., Nature, 533, 420-424 (2016); Gaudelli et al., Nature, 551, 464-471 (2017); Komor et al., Science Advances, 3:eaao4774 (2017), and Rees et al., Nat Rev Genet. 2018 December; 19(12):770-788. doi: 10.1038/s41576-018-0059-1, which are hereby incorporated by reference in their entirety.

In some embodiments, the base editor is a cytosine base editor (CBE). In general, a CBE comprises a cytosine base editing enzyme and a catalytically inactive effector protein. In some embodiments, the catalytically inactive effector protein is a catalytically inactive variant of a Cas effector protein described herein. The CBE may convert a cytosine to a thymine. In some embodiments, the base editor is an adenine base editor (ABE). In general, an ABE comprises an adenine base editing enzyme and a catalytically inactive effector protein. In some embodiments, the catalytically inactive effector protein is a catalytically inactive variant of a Cas effector protein described herein. The ABE generally converts an adenine to a guanine. In some embodiments, the base editor is a cytosine to guanine base editor (CGBE). In general, a CGBE converts a cytosine to a guanine.

In some embodiments, the base editor is a CBE. In some embodiments, the cytosine base editing enzyme is a cytosine deaminase. In some embodiments, the cytosine deaminase is an APOBEC1 cytosine deaminase, which accept ssDNA as a substrate but is incapable of cleaving dsDNA, fused to a catalytically inactive effector protein. In some embodiments, when bound to its cognate DNA, the catalytically inactive effector protein performs local denaturation of the DNA duplex to generate an R-loop in which the DNA strand not paired with the guide RNA exists as a disordered single-stranded bubble. In some embodiments, the catalytically inactive effector protein generated ssDNA R-loop enables the CBE to perform efficient and localized cytosine deamination in vitro. In some examples, deamination activity is exhibited in a window of about 4 to about 10 base pairs. In some embodiments, fusion to the catalytically inactive effector protein presents the target site to APOBEC1 in high effective molarity, enabling the CBE to deaminate cytosines located in a variety of different sequence motifs, with differing efficacies. In some embodiments, the CBE is capable of mediating RNA-programmed deamination of target cytosines in vitro. In some embodiments, the CBE is capable of mediating RNA-programmed deamination of target cytosines in vivo. In some embodiments, the cytosine base editing enzyme is a cytosine base editing enzyme described by Koblan et al. (2018) Nature Biotechnology 36:848-846; Komor et al. (2016) Nature 533:420-424; Koblan et al. (2021) "Efficient CG-to-GC base editors developed using CRISPRi screens, target-library analysis, and machine learning," Nature Biotechnology; Kurt et al. (2021) Nature Biotechnology 39:41-46; Zhao et al. (2021) Nature Biotechnology 39:35-40; and Chen et al. (2021) Nature Communications 12:1384, all incorporated herein by reference.

In some embodiments, CBEs comprise a uracil glycosylase inhibitor (UGI) or uracil N-glycosylase (UNG). In some embodiments, base excision repair (BER) of U•G in DNA is initiated by a UNG, which recognizes the U•G mismatch and cleaves the glyosidic bond between uracil and the deoxyribose backbone of DNA. In some embodiments, BER results in the reversion of the U•G intermediate created by the first CBE back to a C•G base pair. In some embodiments, UNG may be inhibited by fusion of uracil DNA glycosylase inhibitor (UGI), in some embodiments, a small protein from bacteriophage PBS, to the C-terminus of the CBE. In some embodiments, UGI is a DNA mimic that potently inhibits both human and bacterial UNG. In some embodiments, a UGI inhibitor is any protein or polypeptide that inhibits UNG. In some embodiments, the CBE mediates efficient base editing in bacterial cells and moderately efficient editing in mammalian cells, enabling conversion of a C•G base pair to a T•A base pair through a U•G intermediate. In some embodiments, the CBE is modified to increase base editing efficiency while editing more than one strand of DNA.

In some embodiments, the CBE nicks the non-edited DNA strand. In some embodiments, the non-edited DNA strand nicked by the CBE biases cellular repair of the U•G mismatch to favor a UA outcome, elevating base editing efficiency. In some embodiments, the APOBEC1-nickase-UGI fusion efficiently edits in mammalian cells, while minimizing frequency of non-target indels.

In some embodiments, the cytidine deaminase is selected from APOBEC1, APOBEC2, APOBEC3C, APOBEC3D, APOBEC3F, APOBEC3G, APOBEC3H, APOBEC4, APOBEC3A, BE1 (APOBEC1-XTEN-dCas9), BE2 (APOBEC1-XTEN-dCas9-UGI), BE3 (APOBEC1-XTEN-dCas9(A840H)-UGI), BE3-Gam, saBE3, saBE4-Gam, BE4, BE4-Gam, saBE4, or saBE4-Gam as described in WO2021163587, WO202108746, WO2021062227, and WO2020123887, which are incorporated herein by reference in their entirety.

In some embodiments, the fusion protein further comprises a non-protein uracil-DNA glcosylase inhibitor (npUGI). In some embodiments, the npUGI is selected from a group of small molecule inhibitors of uracil-DNA glycosylase (UDG), or a nucleic acid inhibitor of UDG. In some embodiments, the non-protein uracil-DNA glcosylase inhibitor (npUGI) is a small molecule derived from uracil. Examples of small molecule non-protein uracil-DNA glcosylase inhibitors, fusion proteins, and Cas-CRISPR systems comprising base editing activity are described in WO202108746, which is incorporated by reference in its entirety.

In some embodiments, the fusion partner is a deaminase, e.g., ADAR1/2, ADAR-2, or AID. In some embodiments, the base editor is an ABE. In some embodiments, the adenine base editing enzyme of the ABE is an adenosine deaminase. In some embodiments, the adenine base editing enzyme is selected from ABE8e, ABE8.20m, APOBEC3A, Anc APOBEC, and BtAPOBEC2. In some embodiments, the ABE base editor is an ABET base editor. In some embodiments, the deaminase or enzyme with deaminase activity is selected from ABE8.1m, ABE8.2m, ABE8.3m, ABE8.4m, ABE8.5m, ABE8.6m, ABE8.7m, ABE8.8m, ABE8.9m, ABE8.10m, ABE8.11m, ABE8.12m, ABE8.13m, ABE8.14m, ABE8.15m, ABE8.16m, ABE8.17m, ABE8.18m, ABE8.19m, ABE8.20m, ABE8.21m, ABE8.22m, ABE8.23m, ABE8.24m, ABE8.1d, ABE8.2d, ABE8.3d, ABE8.4d, ABE8.5d, ABE8.6d, ABE8.7d, ABE8.8d, ABE8.9d, ABE8.10d, ABE8.11d, ABE8.12d, ABE8.13d, ABE8.14d, ABE8.15d, ABE8.16d, ABE8.17d, ABE8.18d, ABE8.19d, ABE8.20d, ABE8.21d, ABE8.22d, ABE8.23d, or ABE8.24d. In some embodiments, the adenine base editing enzyme is ABE8.1d. In some embodiments, the adenosine base editor is ABE9. Exemplary deaminases are described in US20210198330, WO2021041945, WO2021050571A1, and WO2020123887, all of which are incorporated herein by reference in their entirety. Sequences of a selection of these enzymes are provided in TABLE 2. In some embodiments, the adenine base editing enzyme is an adenine base editing enzyme described in Chu et al., (2021) The CRISPR Journal 4:2: 169-177, incorporated herein by reference. In some embodiments, the adenine deaminase is an adenine deaminase described by Koblan et al. (2018) Nature Biotechnology 36:848-846, incorporated herein by reference. In some embodiments, the adenine base editing enzyme is an adenine base editing enzyme described by Tran et al. (2020) Nature Communications 11:4871. Additional examples of deaminase domains are also described in WO2018027078 and WO2017070632, which are hereby incorporated by reference in their entirety.

In some embodiments, an ABE converts an A•T base pair to a GC base pair. In some embodiments, the ABE converts a target A•T base pair to GC in vivo. In some embodiments, the ABE converts a target A•T base pair to GC in vitro. In some embodiments, ABEs provided herein reverse spontaneous cytosine deamination, which has been linked to pathogenic point mutations. In some embodiments, ABEs provided herein enable correction of pathogenic SNPs (~47% of disease-associated point mutations). In some embodiments, the adenine comprises exocyclic amine that has been deaminated (e.g., resulting in altering its base pairing preferences). In some embodiments, deamination of adenosine yields inosine. In some embodiments, inosine exhibits the base-pairing preference of guanine in the context of a polymerase active site, although inosine in the third position of a tRNA anticodon is capable of pairing with A, U, or C in mRNA during translation. In some embodiments, an ABE comprises an engineered adenosine deaminase enzyme capable of acting on ssDNA.

In some embodiments, a base editor comprises an adenosine deaminase variant that differs from a naturally occurring deaminase. Relative to the naturally occurring deaminase, the adenosine deaminase variant may comprise a V82S alteration, a T166R alteration, or a combination thereof. In some embodiments, the adenosine deaminase variant comprises at least one of the following alterations relative to a naturally occurring adenosine deaminase: Y147T, Y147R, Q154S, Y123H, and Q154R, which are incorporated herein by reference in their entirety.

In some embodiments, a base editor comprises a deaminase dimer. In some embodiments, a base editor is a deaminase dimer further comprising a base editing enzyme and an adenine deaminase (e.g., TadA).

In some embodiments, the adenosine deaminase is a TadA monomer (e.g., Tad*7.10, TadA*8 or TadA*9). In some embodiments, the adenosine deaminase is a TadA*8 variant. Such a TadA*8 variant includes TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24 as described in WO2021163587 and WO2021050571, which are each hereby incorporated by reference in its entirety.

In some embodiments, a base editor is a deaminase dimer comprising a base editing enzyme fused to TadA via a linker. In some embodiments the linker comprises or consists of at least a portion of the sequence:

In some embodiments, the amino terminus of the fusion partner protein is linked to the carboxy terminus of the effector protein via the linker. In some embodiments, the carboxy terminus of the fusion partner protein is linked to the amino terminus of the effector protein via the linker.

In some embodiments, the base editing enzyme is fused to TadA at the N-terminus. In some embodiments, the base editing enzyme is fused to TadA at the C-terminus. In some embodiments, the base editing enzyme is a deaminase dimer comprising an ABE. In some embodiments, the deaminase dimer comprises an adenosine deaminase. In some embodiments, the deaminase dimer comprises TadA fused to an adenine base editing enzyme selected from ABE8e, ABE8.20m, APOBEC3A, Anc APOBEC, and BtAPOBEC2. In some embodiments TadA is fused to ABE8e or a variant thereof. In some embodiments TadA is fused to ABE8e or a variant thereof at the amino-terminus (ABE8e-TadA). In some embodiments, TadA is fused to ABE8e or a variant thereof at the carboxy terminus (ABE8e-TadA).

In some embodiments, the amino terminus of the fusion partner protein is linked to the carboxy terminus of the effector protein via the linker. In some embodiments, the carboxy terminus of the fusion partner protein is linked to the amino terminus of the effector protein via the linker. In some embodiments, a linker can comprise a XTEN10 linker (SEQ ID NO: 711), an XTEN40 linker (SEQ ID NO: 734) or an XTEN80 linker (SEQ ID NO: 735). In some embodiments, a linker can comprise an amino acid sequence that is at least 60%, at least 65%, at least 70%, at least 75%, at least 80%, at least 85%, at least 90%, at least 95%, at least 98%, at least 99% or 100% identical to SEQ ID NOs: 711, 734, or 735.

In some embodiments, fusion partners comprise an amino acid sequence that is at least 50%, at least 55%, at least 60%, at least 65%, at least 70%, at least 75%, at least 80%, at least 85%, at least 90%, at least 95%, at least 98%, at least 99% or 100% identical to ABE8e (SEQ ID NO: 713). In some embodiments, fusion partners comprise an amino acid sequence that is at least 50%, at least 55%, at least 60%, at least 65%, at least 70%, at least 75%, at least 80%, at least 85%, at least 90%, at least 95%, at least 98%, at least 99% or 100% identical to ABE8.20m (SEQ ID NO: 714). In some embodiments, fusion partners comprise an amino acid sequence that is at least 50%, at least 55%, at least 60%, at least 65%, at least 70%, at least 75%, at least 80%, at least 85%, at least 90%, at least 95%, at least 98%, at least 99% or 100% identical to APOBEC3 (SEQ ID NO: 732). In some embodiments, fusion partners comprise an amino acid sequence that is at least 50%, at least 55%, at least 60%, at least 65%, at least 70%, at least 75%, at least 80%, at least 85%, at least 90%, at least 95%, at least 98%, at least 99% or 100% identical to AncBE4Max (SEQ ID NO: 733).

Modifying Proteins

In some instances, a fusion partner provides enzymatic activity that modifies a protein (e.g., a histone) associated with a target nucleic acid. Such enzymatic activities include, but are not limited to, methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, de-ribosylation activity, myristoylation activity, and demyristoylation activity.

In some instances, the fusion partner has enzymatic activity that modifies a protein associated with a target nucleic acid. The protein may be a histone, an RNA binding protein, or a DNA binding protein. Examples of such protein modification activities include methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB1, SET1A, SET1B, MLL1 to 5, ASH1, SYMD2, NSD1, DOT1L, Pr-SET7/8, SUV4-20H1, EZH2, RIZ1); demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3); acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HBO1/MYST2, HMOF/MYST1, SRC1, ACTR, P160, CLOCK); deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11); kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

In some instances, the fusion partner is a chloroplast transit peptide (CTP), also referred to as a plastid transit peptide. In some instances, this targets the fusion protein to a chloroplast. Chromosomal transgenes from bacterial sources must have a sequence encoding a CTP sequence fused to a sequence encoding an expressed protein if the expressed protein is to be compartmentalized in the plant plastid (e.g. chloroplast). The CTP is removed in a processing step during translocation into the plastid. Accordingly, localization of an exogenous protein to a chloroplast is often accomplished by means of operably linking a polynucleotide sequence encoding a CTP sequence to the 5' region of a polynucleotide encoding the exogenous protein. In some instances, the CTP is located at the N-terminus of the fusion protein. Processing efficiency may, however, be affected by the amino acid sequence of the CTP and nearby sequences at the amino terminus (NH2 terminus) of the peptide.

In some instances, the fusion partner is an endosomal escape peptide. In some instances, an endosomal escape protein comprises the amino acid sequence GLFXALLXLLXSLWXLLLXA (SEQ ID NO: 200), wherein each X is independently selected from lysine, histidine, and arginine. In some instances, an endosomal escape protein comprises the amino acid sequence GLFHALLHLLHSLWHLLLHA (SEQ ID NO: 201). In some instances, the amino acid sequence of the endosomal escape protein is SEQ ID NO: 200 or SEQ ID NO: 201.

Prime Editing

In some embodiments, a fusion protein and/or a fusion partner can comprise a prime editing enzyme. When used herein, a prime editing enzyme can describe a protein, polypeptide, or fragment thereof that is capable of catalyzing the modification (insertion, deletion, or base-to-base conversion) of a target nucleotide or nucleotide sequence in a nucleic acid. A prime editing enzyme capable of catalyzing such a reaction includes a reverse transcriptase. A prime editing enzyme may require a prime editing guide RNA (pegRNA) to catalyze the modification. Such a pegRNA can be capable of identifying the nucleotide or nucleotide sequence in the target nucleic acid to be edited and encoding the new genetic information that replaces the targeted nucleotide or nucleotide sequence in the nucleic acid. A prime editing enzyme may require a prime editing guide RNA (pegRNA) and a single guide RNA to catalyze the modification.

In some embodiments, a prime editing enzyme is a protein, a polypeptide or a fragment thereof that is capable of catalyzing the modification (insertion, deletion, or base-to-base conversion) of a target nucleotide or nucleotide sequence in a nucleic acid. A prime editing enzyme capable of catalyzing such a reaction includes a reverse transcriptase. A prime editing enzyme may require a prime editing guide RNA (pegRNA) to catalyze the modification. Such a pegRNA can be capable of identifying the nucleotide or nucleotide sequence in the target nucleic acid to be edited and encoding the new genetic information that replaces the targeted nucleotide or nucleotide sequence in the nucleic acid. A prime editing enzyme may require a prime editing guide RNA (pegRNA) and a single guide RNA to catalyze the modification. In some embodiments, such a prime editing enzyme is an M-MLV RT enzyme or a mutant thereof. In some embodiments, the M-MLV RT enzyme comprises at least one mutation selected from D200N, L603W, T330P, T306K, and W313F relative to wildtype M-MLV RT enzyme.

Recombinases

In some embodiments, the fusion partners comprise a recombinase domain. In some embodiments, the enzymatically inactive protein is fused with a recombinase. In some embodiments, the recombinase is a site-specific recombinase. In some embodiments, the fusion partners comprise a recombinase domain wherein the recombinase is a site-specific recombinase. In some embodiments, described herein is a programmed nuclease comprising reduced nuclease activity or no nuclease activity and fused with a recombinase, wherein the recombinase can be a site-specific recombinase. Such polypeptides can be used for site-directed transgene insertion. Examples of site-specific recombinases include a tyrosine recombinase (e.g., Cre, Flp or lambda integrase), a serine recombinase (e.g., gamma-delta resolvase, Tn3 resolvase, Sin resolvase, Gin invertase, Hin invertase, Tn5044 resolvase, IS607 transposase and integrase), or mutants or variants thereof. In some embodiments, the recombinase is a serine recombinase. Non-limiting examples of serine recombinases include, but are not limited to, gamma-delta resolvase, Tn3 resolvase, Sin resolvase, Gin invertase, Hin invertase, Tn5044 resolvase, IS607 transposase, and IS607 integrase. In some embodiments, the site-specific recombinase is an integrase. Non-limiting examples of integrases include, but are not limited to: Bxb1, wBeta, BL3, phiR4, A118, TG1, MR11, phi370, SPBc, TP901-1, phiRV, FC1, K38, phiBT1, and phiC31. Further discussion and examples of suitable recombinase fusion partners are described in U.S. Pat. No. 10,975,392, which is incorporated herein by reference in its entirety.

In some embodiments, the fusion protein comprises a linker that links the recombinase domain to the Cas-CRISPR domain of the effector protein. In some embodiments, the linker is The-Ser.

Additional Fusion Partners

In some embodiments, the fusion partner is a nuclear localization signal (NLS). In some cases, said NLS may have a sequence of KRPAATKKAGQAKKKKEF (SEQ ID NO: 800). The NLS can be selected to match the cell type of interest, for example several NLSs are known to be functional in different types of eukaryotic cell e.g. in mammalian cells. Suitable NLSs include the SV40 large T antigen NLS (PKKKRKV, SEQ ID NO: 712) and the c-Myc NLS (PAAKRVKLD, SEQ ID NO: 801). In some embodiments, an NLS may be the SV40 large T antigen NLS or the c-Myc NLS. NLSs that are functional in plant cells are described in Chang et al., (Plant Signal Behav. 2013 October; 8(10):e25976). In some embodiments, an NLS sequence can be selected from the following consensus sequences: KR(K/R)R (SEQ ID NO: 802), K(K/R)RK (SEQ ID NO: 803); (P/R)XXKR(^DE)(K/R) (SEQ ID NO: 804); KRX(W/F/Y)XXAF; (SEQ ID NO: 805); (R/P)XXKR(K/R)(^DE) (SEQ ID NO: 806); LGKR(K/R)(W/F/Y) (SEQ ID NO: 807); KRX10-12K(KR)(KR) (SEQ ID NO: 808) or KRX10-12K(KR)X(K/R) (SEQ ID NO: 809). In some cases, (^DE) means any amino acid besides Asp or Glu. In some cases, X10-12 means 10, 11, or 12 residues of X (any amino acid). In some cases a "/" means either residue 1 or residue 2, for example (K/R) means residue K or R. In some cases, the NLS is linked to an effector protein by an amine group, also referred to as a peptide bond, or by one or more amino acids.

In some embodiments, the nucleoplasmin NLS (KR-PAATKKAGQAKKKKEF (SEQ ID NO: 800)) is linked or fused to the C-terminus of the effector protein. In some embodiments, the SV40 NLS (PKKKRKVGIHGVPAA) (SEQ ID NO: 810) is linked or fused to the N-terminus of the effector protein. In preferred embodiments, the nucleoplasmin NLS (SEQ ID NO: 800) is linked or fused to the C-terminus of the effector protein and the SV40 NLS (SEQ ID NO: 810) is linked or fused to the N-terminus of the effector protein.

Further suitable fusion partners include, but are not limited to, proteins (or fragments/domains thereof) that are boundary elements (e.g., CTCF), proteins and fragments thereof that provide periphery recruitment (e.g., Lamin A, Lamin B, etc.), protein docking elements (e.g., FKBP/FRB, Pil1/Aby1, etc.).

Linkers for Fusion Partners

In general, effector proteins and fusion partners of a fusion effector protein are connected via a linker. The linker may comprise or consist of a covalent bond. The linker may comprise or consist of a chemical group. In some embodiments, the linker comprises an amino acid. In some cases, a linker comprises a bond or molecule that links a first polypeptide to a second polypeptide. In some instances, a peptide linker comprises at least two amino acids linked by an amide bond. In general, the linker connects a terminus of the effector protein to a terminus of the fusion partner. In some embodiments, the carboxy terminus of the effector protein is linked to the amino terminus of the fusion partner. In some embodiments, the carboxy terminus of the fusion partner is linked to the amino terminus of the effector protein.

In some instances, a terminus of the D2S effector protein is linked to a terminus of the fusion partner through an amide bond. In some instances, a D2S effector protein is coupled to a fusion partner via a linker protein. In some embodiments, a linker, comprises a bond or molecule that links a first polypeptide to a second polypeptide. A peptide linker comprises at least two amino acids linked by an amide bond. The linker protein may have any of a variety of amino acid sequences. A linker protein may comprise a region of rigidity (e.g., beta sheet, alpha helix), a region of flexibility, or any combination thereof. In some instances, the linker comprises small amino acids, such as glycine and alanine, that impart high degrees of flexibility. The ordinarily skilled artisan will recognize that design of a peptide conjugated to any desired element may include linkers that are all or partially flexible, such that the linker may include a flexible linker as well as one or more portions that confer less flexible structure. Suitable linkers include proteins of 4 linked amino acids to 40 linked amino acids in length, or between 4 linked amino acids and 25 linked amino acids in length. In some embodiments, when linked amino acids are described herein, it can refer to at least two amino acids linked by an amide bond.

These linkers may be produced by using synthetic, linker-encoding oligonucleotides to couple the proteins, or may be encoded by a nucleic acid sequence encoding a fusion protein (e.g., an effector protein coupled to a fusion partner). Examples of linker proteins include glycine polymers (G)n, glycine-serine polymers (including, for example, (GS)n, GSGGSn (SEQ ID NO: 170), GGSGGSn (SEQ ID NO: 171), and GGGSn (SEQ ID NO: 172), where n is an integer of at least one), glycine-alanine polymers, and alanine-serine polymers. Exemplary linkers may comprise amino acid sequences including, but not limited to, GS (SEQ ID NO: 169), GSGGS (SEQ ID NO: 170), GGSGGS (SEQ ID NO: 171), GGGS (SEQ ID NO: 172), GGSG (SEQ ID NO: 173), GGSGG (SEQ ID NO: 174), GSGSG (SEQ ID NO: 175), GSGGG (SEQ ID NO: 176), GGGSG (SEQ ID NO: 177), and GSSSG (SEQ ID NO: 178).

In some embodiments, an effector protein described herein is purified. For example, a D2S effector protein is purified for ex vivo ribonucleoprotein editing. In some instances, an effector protein is purified with a TEV-cleavable maltose binding protein (MBP) tag. In some instances, an effector protein comprises a His tag, a FLAG tag, a GFP tag, or a combination of tags. For example, an effector protein of SEQ ID NOs: 1-45, 202-293, or 728-731 can comprise a component (e.g. tag) disclosed in Table 37. In some instances, an effector protein comprises a T2A tag. In some cases, TEV cleavage occurs before the effector protein is introduced into a cell. After TEV cleavage, an effector protein's N terminus retains three additional amino acids (SerAsnAla; SNA), this also occurs when nuclear localization signal are added to the effector protein. In some cases, an effector protein purified with a TEV-cleavable maltose binding protein (MBP) tag is delivered to a cell with a lipid nanoparticle (LNP). In some cases, a TEV cleaved version of an effector protein is used for ex vivo purposes. In some cases, a TEV cleaved version of an effector protein is used for in vivo purposes.

In some embodiments, a guide RNA for editing a target nucleic acid comprises a sequence that is at least is at least 75%, at least 80%, at least 85%, at least 90%, at least 95%, at least 98%, at least 99% or 100% identical to any one of SEQ ID NOs: 715-727.

Nuclease-Dead D2S Effector Proteins

In some instances, the D2S effector protein can comprise an enzymatically inactive (e.g., catalytically inactive) and/or "dead" (abbreviated by "d") effector protein in combination (e.g., fusion) with a polypeptide comprising recombinase activity. Although a D2S effector protein normally has nuclease activity, in some instances, a D2S effector protein does not have nuclease activity. In some instances, an effector protein comprising at least 60%, at least 65%, at least 70%, at least 75%, at least 80%, at least 85%, at least 90%, at least 92%, at least 95%, at least 97%, at least 98%, at least 99%, or 100% sequence identity with any one of SEQ ID NO: 1-45, 202-293, or 728-731 is a nuclease-dead effector protein. In some instances, the effector protein comprising at least 60%, at least 65%, at least 70%, at least 75%, at least 80%, at least 85%, at least 90%, at least 92%, at least 95%, at least 97%, at least 98%, at least 99%, or 100% sequence identity with any one of SEQ ID NO: 1-45 and 202-293 is modified or engineered to be a nuclease-dead effector protein. In some instances, an effector protein comprising at least 60%, at least 65%, at least 70%, at least 75%, at least 80%, at least 85%, at least 90%, at least 92%, at least 95%, at least 97%, at least 98%, at least 99%, or 100% sequence identity with any one of SEQ ID NOs: 728-731 is a nuclease-dead effector protein.

In some embodiments, catalytic residues of a RuvC domain are a first aspartic acid (D), glutamic acid (E), and a second aspartic acid (D). In some embodiments, the catalytic active residues of CasM.19952 (SEQ ID NO: 23) are D267, E363, and D450. Many amino acid replacements of any catalytic residue can inactivate the nuclease. The most common mutations are converting these residues to alanine or to other amino acids that substitute the acid side chain while maintaining the structural similarity, e.g., such as D (aspartate) to N (asparagine), or E (glutamate) to Q (glutamine). In some embodiments, D267A, E363A, D450A, D267N, E363Q, D450N are all catalytically dead mutants of CasM.19952. In some embodiments, D267A is a catalytically inactive mutant of CasM.286251 (SEQ ID NO: 25).

D2S effector protein can comprise a modified form of a wild type counterpart. The modified form of the wild type counterpart can comprise an amino acid change (e.g., deletion, insertion, or substitution) that reduces the nucleic acid-cleaving activity of the effector protein. For example, a nuclease domain (e.g., HEPN domain) of a D2S effector polypeptide can be deleted or mutated so that it is no longer functional or comprises reduced nuclease activity. The modified form of the effector protein can have less than 90%, less than 80%, less than 70%, less than 60%, less than 50%, less than 40%, less than 30%, less than 20%, less than 10%, less than 5%, or less than 1% of the nucleic acid-cleaving activity of the wild-type counterpart. The modified form of an effector protein can have no substantial nucleic acid-cleaving activity. When an effector protein is a modified form that has no substantial nucleic acid-cleaving activity, it can be referred to as enzymatically inactive and/or dead. A dead D2S effector polypeptide can bind to a target nucleic acid sequence but may not cleave the target nucleic acid sequence. A dead D2S effector polypeptide can associate with a guide nucleic acid to activate or repress transcription of a target nucleic acid sequence.

V. Multimeric Complexes

Compositions, systems, and methods of the present disclosure may comprise a multimeric complex or uses thereof, wherein the multimeric complex comprises multiple effector proteins that non-covalently interact with one another. A multimeric complex may comprise enhanced activity relative to the activity of any one of its effector proteins alone. For example, a multimeric complex comprising two D2S effector proteins may comprise greater nucleic acid binding affinity, cis-cleavage activity, and/or transcollateral cleavage activity than that of either of the D2S effector proteins provided in monomeric form. A multimeric complex may have an affinity for a target region of a target nucleic acid and is capable of catalytic activity (e.g., cleaving, nicking or modifying the nucleic acid) at or near the target region. Multimeric complexes may be activated when complexed with a guide nucleic acid. Multimeric complexes may be activated when complexed with a guide nucleic acid and a target nucleic acid. In some instances, the multimeric complex cleaves the target nucleic acid. In some instances, the multimeric complex nicks the target nucleic acid.

Various aspects of the present disclosure include compositions and methods comprising multiple effector proteins, and uses thereof, respectively. A D2S effector protein comprising at least 70% sequence identity to any one of SEQ ID NO: 1-SEQ ID NO: 45 and SEQ ID NO: 202 to SEQ ID NO: 293 may be provided with a second effector protein. A D2S effector protein comprising at least 70% sequence identity to any one of SEQ ID NO: 1-SEQ ID NO: 45 and SEQ ID NO: 202 to SEQ ID NO: 293 may be provided with a second effector protein. A D2S effector protein comprising at least 70% sequence identity to any one of SEQ ID NO: 728-731 may be provided with a second effector protein. Two effector proteins may target different nucleic acid sequences. Two effector proteins may target different types of nucleic acids (e.g., a first effector protein may target double- and single-stranded nucleic acids, and a second effector protein may only target single-stranded nucleic acids).

In some instances, multimeric complexes comprise at least one D2S effector protein, or a fusion protein thereof, comprising an amino acid sequence with at least 65%, at least 70%, at least 75%, at least 80%, at least 85%, at least 90%, at least 95% or 100% identity to any one of SEQ ID NOs: 1-45, 202-293, or 728-731. In some instances, multimeric complexes comprise at least one D2S effector protein or a fusion protein thereof, wherein the amino acid sequence of the D2S effector protein is at least 65%, at least 70%, at least 75%, at least 80%, at least 85%, at least 90%, at least 95% or 100% identical to any one of SEQ ID NOs: 1-45, 202-293, or 728-731.

In some instances, the multimeric complex is a dimer comprising two effector proteins of identical amino acid sequences. In some instances, the multimeric complex comprises a first effector protein and a second effector protein, wherein the amino acid sequence of the first effector protein is at least 90%, at least 92%, at least 94%, at least 96%, at least 98% identical, or at least 99% identical to the amino acid sequence of the second effector protein.

In some instances, the multimeric complex is a heterodimeric complex comprising at least two effector proteins of different amino acid sequences. In some instances, the multimeric complex is a heterodimeric complex comprising a first effector protein and a second effector protein, wherein the amino acid sequence of the first effector protein is less than 90%, less than 85%, less than 80%, less than 75%, less than 70%, less than 65%, less than 60%, less than 55%, less than 50%, less than 45%, less than 40%, less than 35%, less than 30%, less than 25%, less than 20%, less than 15%, or less than 10% identical to the amino acid sequence of the second effector protein.

In some instances, a multimeric complex comprises at least two effector proteins. In some instances, a multimeric complex comprises more than two effector proteins. In some instances, a multimeric complex comprises two, three or four effector proteins. In some instances, at least one effector protein of the multimeric complex comprises an amino acid sequence with at least 65%, at least 70%, at least 75%, at least 80%, at least 85%, at least 90%, at least 95% or 100% identity to any one of SEQ ID NOs: 1-45, 202-293, or 728-731. In some instances, each effector protein of the multimeric complex comprises an amino acid sequence with at least 65%, at least 70%, at least 75%, at least 80%, at least 85%, at least 90%, at least 95% or 100% identity to any one of SEQ ID NOs: 1-45, 202-293, or 728-731.

VI. Engineered Guide RNAs

The compositions, systems, and methods of the present disclosure may comprise a guide nucleic acid, or a nucleic acid molecule (e.g., DNA molecule) encoding the guide nucleic acid, or a use thereof. When a guide nucleic acid is described herein, it can refer to a nucleic acid comprising: a first nucleotide sequence that hybridizes to a target nucleic acid; and a second nucleotide sequence that is capable of connecting an effector protein to the nucleic acid by either a) hybridizing to a portion of an additional nucleic acid that is bound by an effector protein (e.g., a tracrRNA) orb) being non-covalently bound by an effector protein. The first sequence may be referred to herein as a spacer sequence. In some instances, the second sequence may be referred to herein as a repeat sequence. In some instances, the second sequence may comprise a portion of, or all of a repeat sequence or a tracrRNA. In some instances, the first sequence is located 5' of the second nucleotide sequence. In some instances, the first sequence is located 3' of the second nucleotide sequence.

Provided herein are compositions comprising a D2S effector protein and an engineered guide RNA. In general, a guide nucleic acid is a nucleic acid molecule that binds to an effector protein (e.g., a Cas effector protein), thereby forming a ribonucleoprotein complex (RNP). In some instances, the engineered guide RNA imparts activity or sequence selectivity to the effector protein. In some embodiments a guide nucleic acid comprises a nucleic acid comprising: a first nucleotide sequence that hybridizes to a target nucleic acid; and a second nucleotide sequence that is capable of being non-covalently bound by an effector protein. The first sequence may be referred to herein as a spacer sequence. The second sequence may be referred to herein as a repeat sequence. In some instances, the first sequence is located 5' of the second nucleotide sequence. In some instances, the first sequence is located 3' of the second nucleotide sequence. Guide nucleic acids, when complexed with an effector protein, may bring the effector protein into proximity of a target nucleic acid. Sufficient conditions for hybridization of a guide nucleic acid to a target nucleic acid and/or for binding of a guide nucleic acid to an effector protein include in vivo physiological conditions of a desired cell type or in vitro conditions sufficient for assaying catalytic activity of a protein, polypeptide or peptide described herein, such as the nuclease activity of an effector protein. Guide nucleic acids may comprise DNA, RNA, or a combination thereof (e.g., RNA with a thymine base). Guide nucleic acids may include a chemically modified nucleobase or phosphate backbone. Guide nucleic acids may be referred to herein as a guide RNA (gRNA). However, a guide RNA is not limited to ribonucleotides, but may comprise deoxyribonucleotides and other chemically modified nucleotides.

In general, the engineered guide RNA comprises a CRISPR RNA (crRNA) that is at least partially complementary to a target nucleic acid. In some cases, the nucleotide sequence that hybridizes to a target nucleic acid may be referred to herein as a spacer sequence. In some instances, the engineered guide RNA comprises a trans-activating crRNA (tracrRNA), at least a portion of which interacts with the effector protein. In some embodiments, a trans-activating RNA (tracrRNA), is a nucleic acid that comprises a first sequence that is capable of being non-covalently bound by an effector protein. In some embodiments, tracrRNAs are covalently linked to a crRNA. The tracrRNA may hybridize to a portion of the guide RNA that does not hybridize to the target nucleic acid. In some instances, the crRNA and tracrRNA are provided as a single guide RNA (sgRNA). In some instances, a crRNA and tracrRNA function as two separate, unlinked molecules.

In some embodiments, engineered guide RNAs comprise a crRNA or a portion thereof (e.g., a repeat sequence or a spacer sequence). In some embodiments, the crRNA comprises a first sequence, often referred to herein as a spacer sequence, that hybridizes to a target sequence of a target nucleic acid, and a second sequence that hybridizes to a portion of a tracrRNA, often referred to herein as a repeat sequence. In some embodiments, the repeat sequence is capable of being non-covalently bound by an effector protein. In some embodiments, the crRNA is covalently linked to an additional nucleic acid that interacts with the effector protein. The crRNA may be linked to the additional nucleic acid via an internucleoside linkage (e.g, a phosphodiester bond or phosphorothioate bond). The crRNA may be linked to the additional nucleic acid via one or more linker nucleotides. In some embodiments, the additional nucleic acid comprises a tracrRNA. In some embodiments, the additional nucleic acid comprises an intermediary RNA. In such embodiments, the additional nucleic acid that interacts with the effector protein, for simplicity, can be referred to herein as a tracrRNA or tracrRNA sequence because such an additional nucleic acid can be based on or derived from a tracrRNA, thereby having all or a portion of a tracrRNA sequence. However, it is recognized that in such a context the additional nucleic acid is not a true tracrRNA because it does not act in trans. In some embodiments, a trans-activating RNA (tracrRNA) comprises a nucleic acid that comprises a first sequence that is capable of being non-covalently bound by an effector protein. TracrRNAs may comprise a second sequence that hybridizes to a portion of a crRNA, which may be referred to as a repeat hybridization sequence. In some embodiments, tracrRNAs are covalently linked to a crRNA. A tracrRNA may include deoxyribonucleosides, ribonucleosides, chemically modified nucleosides, or any combination thereof. A tracrRNA may be separate from, but form a complex with, a crRNA and an effector protein. A tracrRNA may include a nucleotide sequence that hybridizes with a portion of a crRNA. A tracrRNA may comprise a secondary structure (e.g., one or more hairpin loops) that facilitates the binding of an effector protein to a guide nucleic acid and/or modification activity of an effector protein on a target nucleic acid. A tracrRNA may include a repeat hybridization region and a hairpin region. The repeat hybridization region may hybridize to all or part of the repeat sequence of a guide nucleic acid. The repeat hybridization region may be positioned 3' of the hairpin region. The repeat hybridization region may be positioned 5' of the hairpin region. The hairpin region may include a first sequence, a second sequence that is reverse complementary to the first sequence, and a stem-loop linking the first sequence and the second sequence.

In some instances, the engineered guide RNA comprises a second sequence, at least a portion of which interacts with the effector protein. In some instances, the second sequence may be referred to herein as a repeat sequence. In some instances, the second sequence may be referred to herein as a handle sequence. In some instances, the handle sequence may comprise a portion of, or all of a repeat sequence.

Guide nucleic acids are often referred to as "guide RNA." However, a guide nucleic acid may comprise deoxyribonucleotides. The term "guide RNA," as well as crRNA and tracrRNA, includes guide nucleic acids comprising DNA bases and RNA bases. The term "guide RNA," which can include crRNA, tracrRNA, second sequence, repeat sequence, handle sequence, or any combination thereof, includes guide nucleic acids comprising DNA bases and RNA bases.

Guide nucleic acids described herein may bind to a D2S effector protein or multimeric complex thereof, wherein the amino acid sequence of the D2S effector protein is at least 70%, at least 75%, at least 80%, at least 85%, at least 90%, at least 92%, at least 95%, at least 97%, at least 98%, at least 99%, or 100% identical to any one of SEQ ID NO: 1-45, 202-293, or 728-731.

In general, the crRNA comprises a spacer region that hybridizes to a target sequence of a target nucleic acid, and a repeat region that interacts with the D2S effector effector protein. The repeat region may also be referred to as a "protein-binding segment." Typically, the repeat region is adjacent to the spacer region. For example, a guide RNA that interacts with the D2S effector effector protein comprises a repeat region that is 5' of the spacer region. The spacer region of the guide RNA may comprise complementarity with (e.g., hybridize to) a target sequence of a target nucleic acid. In some cases, the spacer region is 15-28 linked nucleosides in length. In some cases, the spacer region is 15-26, 15-24, 15-22, 15-20, 15-18, 16-28, 16-26, 16-24, 16-22, 16-20, 16-18, 17-26, 17-24, 17-22, 17-20, 17-18, 18-26, 18-24, or 18-22 linked nucleosides in length. In some cases, the spacer region is 18-24 linked nucleosides in length. In some cases, the spacer region is at least 15 linked nucleosides in length. In some cases, the spacer region is at least 16, 18, 20, or 22 linked nucleosides in length. In some cases, the spacer region comprises at least 10, 11, 12, 13, 14, 15, 16, 17, 18, 19, 20, 21, 22, 23, 24, 25, 26, 27, 28, 29, or 30 nucleotides. In some cases, the spacer region is at least 17 linked nucleosides in length. In some cases, the spacer region is at least 18 linked nucleosides in length. In some cases, the spacer region is at least 20 linked nucleosides in length. In some cases, the spacer region is at least 80%, at least 85%, at least 90%, at least 95% or 100% complementary to a target sequence of the target nucleic acid. In some cases, the spacer region is 100% complementary to the target sequence of the target nucleic acid. In some cases, the spacer region comprises at least 15 contiguous nucleobases that are complementary to the target nucleic acid.

In some embodiments, complementary and "complementarity, with reference to a nucleic acid molecule or nucleotide sequence, comprise the characteristic of a polynucleotide having nucleotides that base pair with their Watson-Crick counterparts (C with G; or A with T) in a reference nucleic acid. For example, when every nucleotide in a polynucleotide forms a base pair with a reference nucleic acid, that polynucleotide is said to be 100% complementary to the reference nucleic acid. In a double stranded DNA or RNA sequence, the upper (sense) strand sequence is in general, understood as going in the direction from its 5'- to 3'-end, and the complementary sequence is thus understood as the sequence of the lower (antisense) strand in the same direction as the upper strand. Following the same logic, the reverse sequence is understood as the sequence of the upper strand in the direction from its 3'- to its 5'-end, while the 'reverse complement' sequence or the 'reverse complementary' sequence is understood as the sequence of the lower strand in the direction of its 5'- to its 3'-end. Each nucleotide in a double stranded DNA or RNA molecule that is paired with its Watson-Crick counterpart called its complementary nucleotide.

In some instances, the guide RNA does not comprise a tracrRNA. In some cases, a D2S effector protein does not require a tracrRNA to locate and/or cleave a target nucleic acid. In some instances, the crRNA of the guide nucleic acid comprises a repeat region and a spacer region, wherein the repeat region binds to the D2S effector protein and the spacer region hybridizes to a target sequence of the target nucleic acid. The repeat sequence of the crRNA may interact with a D2S effector protein, allowing for the guide nucleic acid and the D2S effector protein to form an RNP complex. In some instances, the guide nucleic acid comprises a crRNA comprising a spacer region, and a repeat region or handle region wherein at least a portion of the repeat or handle region binds to the D2S effector protein and the spacer region hybridizes to a target sequence of the target nucleic acid. The repeat sequence of the nucleic acid may interact with a D2S effector protein, allowing for the guide nucleic acid and the D2S effector protein to form an RNP complex.

In some cases, a D2S effector protein or a multimeric complex thereof cleaves a precursor RNA ("pre-crRNA") to produce a guide RNA, also referred to as a "mature guide RNA." A D2S effector protein that cleaves pre-crRNA to produce a mature guide RNA is said to have pre-crRNA processing activity. In some cases, a repeat region of a guide RNA comprises mutations or truncations relative to respective regions in a corresponding pre-crRNA.

In some embodiments, the term "region" as used herein may be used to describe a portion of or all of a corresponding sequence, for example, a spacer region is understood to comprise a portion of or all of a spacer sequence.

The guide RNA may bind to a target nucleic acid (e.g., a single strand of a target nucleic acid) or a portion thereof. The guide nucleic acid may bind to a target nucleic acid such as a nucleic acid from a bacterium, a virus, a parasite, a protozoa, a fungus or other agents responsible for a disease, or an amplicon thereof. The target nucleic acid may comprise a mutation, such as a single nucleotide polymorphism (SNP). A mutation may confer for example, resistance to a treatment, such as antibiotic treatment. The guide nucleic acid may bind to a target nucleic acid, such as DNA or RNA, from a cancer gene or gene associated with a genetic disorder, or an amplicon thereof, as described herein. The guide nucleic acid may comprise a first region complementary to a target nucleic acid (FR1) and a second region that is not complementary to the target nucleic acid (FR2). In some cases, FR1 is located 5' to FR2 (FR1-FR2). In some cases, FR2 is located 5' to FR1 (FR2-FR1).

In some cases, the guide comprises 10, 11, 12, 13, 14, 15, 16, 17, 18, 19, 20, 21, 22, 23, 24, 25, 26, 27, 28, 29, or 30 linked nucleosides. In general, a guide nucleic acid comprises at least linked nucleosides. In some instances, a guide nucleic acid comprises at least 25 linked nucleosides. A guide nucleic acid may comprise 10 to 50 linked nucleosides. In some cases, the guide nucleic acid comprises or consists essentially of about 12 to about 80 linked nucleosides, about 12 to about 50, about 12 to about 45, about 12 to about 40, about 12 to about 35, about 12 to about 30, about 12 to about 25, from about 12 to about 20, about 12 to about 19, about 19 to about 20, about 19 to about 25, about 19 to about 30, about 19 to about 35, about 19 to about 40, about 19 to about 45, about 19 to about 50, about 19 to about 60, about 20 to about 25, about 20 to about 30, about 20 to about 35, about 20 to about 40, about 20 to about 45, about 20 to about 50, or about 20 to about 60 linked nucleosides. In some cases, the guide nucleic acid has about 10 to about 60, about 20 to about 50, or about 30 to about 40 linked nucleosides.

The terms "nucleotide" and "nucleoside" when used in the context of a nucleic acid molecule having multiple residues are used interchangeably and mean the sugar and base of the residue contained in the nucleic acid molecule. The term "nucleobase" when used in the context of a nucleic acid molecule can refer to the base of the residue contained in the nucleic acid molecule, for example, the base of a nucleotide or a nucleoside.

In some embodiments, the guide nucleic acid comprises a nucleotide sequence as described herein (e.g., TABLE 2). Such nucleotide sequences described herein (e.g., TABLE 2) may be described as a nucleotide sequence of either DNA or RNA, however, no matter the form the sequence is described, it is readily understood that such nucleotide sequences can be revised to be RNA or DNA, as needed, for describing a sequence within a guide nucleic acid itself or the sequence that encodes a guide nucleic acid, such as a nucleotide sequence described herein for a vector. Similarly, disclosure of the nucleotide sequences described herein (e.g., TABLE 2) also discloses the complementary nucleotide sequence, the reverse nucleotide sequence, and the reverse complement nucleotide sequence, any one of which can be a nucleotide sequence for use in a guide nucleic acid as described herein.

TABLE 2 provides exemplary compositions comprising D2S effector proteins, crRNAs, and tracrRNAs. Each row in TABLE 2 represents an exemplary composition. In some instances, the crRNA comprises a nucleobase sequence of any one of SEQ ID NOs: 46-90 as shown in TABLE 2. In some instances, the nucleobase sequence of the crRNA is at least 65%, at least 70%, at least 75%, at least 80%, at least 85%, at least 90%, at least 95%, or 100% identical to any one of SEQ ID NO: 46-SEQ ID NO: 90. In some instances, the tracrRNA comprises a nucleobase sequence of any one of SEQ ID NOs: 91-148 as shown in TABLE 2. In some instances, the nucleobase sequence of the tracrRNA is at least 65%, at least 70%, at least 75%, at least 80%, at least 85%, at least 90%, at least 95%, or 100% identical to any one of SEQ ID NO: 91-SEQ ID NO: 148.

TABLE 2

Exemplary Compositions of D2S Effector Protein, crRNA and tracrRNA

| Comp. No. | Protein | crRNA | tracrRNA |
| --- | --- | --- | --- |
| 1 | CasM.298706 (SEQ ID NO: 1) | SEQ ID NO: 46 | SEQ ID NO: 91 |
| 2 | CasM.280604 (SEQ ID NO: 2) | SEQ ID NO: 47 | SEQ ID NO: 92 |
| 3 | CasM.281060 (SEQ ID NO: 3) | SEQ ID NO: 48 | SEQ ID NO: 93 |

TABLE 2-continued

Exemplary Compositions of D2S Effector Protein, crRNA and tracrRNA

| Comp. No. | Protein | crRNA | tracrRNA |
| --- | --- | --- | --- |
| 4 | CasM.284933 (SEQ ID NO: 4) | SEQ ID NO: 49 | SEQ ID NO: 94 |
| 5 | CasM.287908 (SEQ ID NO: 5) | SEQ ID NO: 50 | SEQ ID NO: 95 |
| 6 | CasM.288518 (SEQ ID NO: 6) | SEQ ID NO: 51 | SEQ ID NO: 96 |
| 7 | CasM.293891 (SEQ ID NO: 7) | SEQ ID NO: 52 | SEQ ID NO: 97 |
| 8 | CasM.294270 (SEQ ID NO: 8) | SEQ ID NO: 53 | SEQ ID NO: 98 |
| 9 | CasM.294491 (SEQ ID NO: 9) | SEQ ID NO: 54 | SEQ ID NO: 99 |
| 10 | CasM.295047 (SEQ ID NO: 10) | SEQ ID NO: 55 | SEQ ID NO: 100 |
| 11 | CasM.299588 (SEQ ID NO: 11) | SEQ ID NO: 56 | SEQ ID NO: 101 |
| 12 | CasM.277328 (SEQ ID NO: 12) | SEQ ID NO: 57 | SEQ ID NO: 102 |
| 13 | CasM.297894 (SEQ ID NO: 13) | SEQ ID NO: 58 | SEQ ID NO: 103 |
| 14 | CasM.291449 (SEQ ID NO: 14) | SEQ ID NO: 59 | SEQ ID NO: 104 |
| 15 | CasM.291449 (SEQ ID NO: 14) | SEQ ID NO: 59 | SEQ ID NO: 105 |
| 16 | CasM.297599 (SEQ ID NO: 15) | SEQ ID NO: 60 | SEQ ID NO: 106 |
| 17 | CasM.297599 (SEQ ID NO: 15) | SEQ ID NO: 60 | SEQ ID NO: 107 |
| 18 | CasM.286588 (SEQ ID NO: 16) | SEQ ID NO: 61 | SEQ ID NO: 108 |
| 19 | CasM.286588 (SEQ ID NO: 16) | SEQ ID NO: 61 | SEQ ID NO: 109 |
| 20 | CasM.286910 (SEQ ID NO: 17) | SEQ ID NO: 62 | SEQ ID NO: 110 |
| 21 | CasM.286910 (SEQ ID NO: 17) | SEQ ID NO: 62 | SEQ ID NO: 111 |
| 22 | CasM.292335 (SEQ ID NO: 18) | SEQ ID NO: 63 | SEQ ID NO: 112 |
| 23 | CasM.292335 (SEQ ID NO: 18) | SEQ ID NO: 63 | SEQ ID NO: 113 |
| 24 | CasM.293576 (SEQ ID NO: 19) | SEQ ID NO: 64 | SEQ ID NO: 114 |
| 25 | CasM.293576 ((SEQ ID NO: 19) | SEQ ID NO: 64 | SEQ ID NO: 115 |
| 26 | CasM.294537 (SEQ ID NO: 20) | SEQ ID NO: 65 | SEQ ID NO: 116 |
| 27 | CasM.294537 (SEQ ID NO: 20) | SEQ ID NO: 65 | SEQ ID NO: 117 |
| 28 | CasM.298538 (SEQ ID NO: 21) | SEQ ID NO: 66 | SEQ ID NO: 118 |
| 29 | CasM.298538 (SEQ ID NO: 21) | SEQ ID NO: 66 | SEQ ID NO: 119 |
| 30 | CasM.19924 (SEQ ID NO: 22) | SEQ ID NO: 67 | SEQ ID NO: 120 |
| 32 | CasM.19952 (SEQ ID NO: 23) | SEQ ID NO: 68 | SEQ ID NO: 120 |
| 34 | CasM.274559 (SEQ ID NO: 24) | SEQ ID NO: 69 | SEQ ID NO: 121 |
| 36 | CasM.286251 (SEQ ID NO: 25) | SEQ ID NO: 70 | SEQ ID NO: 122 |
| 38 | CasM.288480 (SEQ ID NO: 26) | SEQ ID NO: 71 | SEQ ID NO: 120 |
| 40 | CasM.288668 (SEQ ID NO: 27) | SEQ ID NO: 72 | SEQ ID NO: 123 |
| 41 | CasM.289206 (SEQ ID NO: 28) | SEQ ID NO: 73 | SEQ ID NO: 121 |
| 43 | CasM.290598 (SEQ ID NO: 29) | SEQ ID NO: 74 | SEQ ID NO: 121 |
| 45 | CasM.290816 (SEQ ID NO: 30) | SEQ ID NO: 75 | SEQ ID NO: 124 |
| 47 | CasM.295071 (SEQ ID NO: 31) | SEQ ID NO: 76 | SEQ ID NO: 122 |
| 49 | CasM.295231 (SEQ ID NO: 32) | SEQ ID NO: 77 | SEQ ID NO: 124 |

TABLE 2-continued

Exemplary Compositions of D2S Effector Protein, crRNA and tracrRNA

| Comp. No. | Protein | crRNA | tracrRNA |
|---|---|---|---|
| 51 | CasM.292139 (SEQ ID NO: 33) | SEQ ID NO: 78 | SEQ ID NO: 125 |
| 52 | CasM.292139 (SEQ ID NO: 33) | SEQ ID NO: 78 | SEQ ID NO: 126 |
| 54 | CasM.279423 (SEQ ID NO: 34) | SEQ ID NO: 79 | SEQ ID NO: 127 |
| 55 | CasM.20054 (SEQ ID NO: 35) | SEQ ID NO: 80 | SEQ ID NO: 128 |
| 56 | CasM.20054 (SEQ ID NO: 35) | SEQ ID NO: 80 | SEQ ID NO: 129 |
| 57 | CasM.282673 (SEQ ID NO: 36) | SEQ ID NO: 81 | SEQ ID NO: 130 |
| 58 | CasM.282673 (SEQ ID NO: 36) | SEQ ID NO: 81 | SEQ ID NO: 131 |
| 59 | CasM.282952 (SEQ ID NO: 37) | SEQ ID NO: 82 | SEQ ID NO: 132 |
| 60 | CasM.282952 (SEQ ID NO: 37) | SEQ ID NO: 82 | SEQ ID NO: 133 |
| 61 | CasM.283262 (SEQ ID NO: 38) | SEQ ID NO: 83 | SEQ ID NO: 134 |
| 62 | CasM.283262 (SEQ ID NO: 38) | SEQ ID NO: 83 | SEQ ID NO: 135 |
| 63 | CasM.284833 (SEQ ID NO: 39) | SEQ ID NO: 84 | SEQ ID NO: 136 |
| 64 | CasM.284833 (SEQ ID NO: 39) | SEQ ID NO: 84 | SEQ ID NO: 137 |
| 65 | CasM.287700 ((SEQ ID NO: 40) | SEQ ID NO: 85 | SEQ ID NO: 138 |
| 66 | CasM.291507 (SEQ ID NO: 41) | SEQ ID NO: 86 | SEQ ID NO: 139 |
| 67 | CasM.291507 (SEQ ID NO: 41) | SEQ ID NO: 86 | SEQ ID NO: 140 |
| 68 | CasM.293410 (SEQ ID NO: 42) | SEQ ID NO: 87 | SEQ ID NO: 141 |
| 69 | CasM.293410 (SEQ ID NO: 42) | SEQ ID NO: 87 | SEQ ID NO: 142 |
| 70 | CasM.295105 (SEQ ID NO: 43) | SEQ ID NO: 88 | SEQ ID NO: 143 |
| 71 | CasM.295105 (SEQ ID NO: 43) | SEQ ID NO: 88 | SEQ ID NO: 144 |
| 72 | CasM.295187 (SEQ ID NO: 44) | SEQ ID NO: 89 | SEQ ID NO: 145 |
| 73 | CasM.295187 (SEQ ID NO: 44) | SEQ ID NO: 89 | SEQ ID NO: 146 |
| 74 | CasM.295929 (SEQ ID NO: 45) | SEQ ID NO: 90 | SEQ ID NO: 147 |
| 75 | CasM.295929 (SEQ ID NO: 45) | SEQ ID NO: 90 | SEQ ID NO: 148 |

TABLE 3 provides exemplary compositions comprising D2S effector proteins and sgRNAs. Each row in TABLE 3 represents an exemplary composition. In some instances, the sgRNA comprises a nucleobase sequence of any one of SEQ ID NOs: 22-33 as shown in TABLE 3. In some instances, the nucleobase sequence of the sgRNA is at least 65%, at least 70%, at least 75%, at least 80%, at least 85%, at least 90%, at least 95%, at least 97%, or at least 98%, at least 99%, or 100% identical to any one of SEQ ID NO: 22-SEQ ID NO: 33.

TABLE 3

Exemplary Compositions of D2S Effector Protein and sgRNA

| Comp. No | Effector protein | SgRNA |
|---|---|---|
| 31 | CasM.19924 (SEQ ID NO: 22) | SEQ ID NO: 149 |
| 33 | CasM.19952 (SEQ ID NO: 23) | SEQ ID NO: 149 |
| 35 | CasM.274559 (SEQ ID NO: 24) | SEQ ID NO: 150 |
| 37 | CasM.286251 (SEQ ID NO: 25) | SEQ ID NO: 151 |
| 39 | CasM.288480 (SEQ ID NO: 26) | SEQ ID NO: 149 |
| 42 | CasM.289206 (SEQ ID NO: 28) | SEQ ID NO: 150 |
| 44 | CasM.290598 (SEQ ID NO: 29) | SEQ ID NO: 150 |
| 46 | CasM.290816 (SEQ ID NO: 30) | SEQ ID NO: 152 |
| 48 | CasM.295071 (SEQ ID NO: 31) | SEQ ID NO: 151 |
| 51 | CasM.295231 (SEQ ID NO: 32) | SEQ ID NO: 152 |
| 53 | CasM.292139 (SEQ ID NO: 33) | SEQ ID NO: 153 or RNA sequence: UUAUUAGAAAUGAAAUAUU UUCUAAUGGGGUUGUUGGA AAGAGCUUUUACUGAAAUU UGUAAAGGUGCCCUGAACU UGAGAAUUGAAAAAUUACU CGAGGAAAUGGUACAUCCA ACUAUUAAAUACUCGUAUU GCU (SEQ ID NO: 937) |

In some instances, a guide nucleic acid can comprise a nucleotide sequence (e.g., a repeat sequence) as shown in TABLE 38. In some instances, a crRNA or a sgRNA comprises a repeat sequence as shown in TABLE 38. In some instances, a guide nucleic acid comprises a sequence that is at least 70%, at least 75%, at least 80%, at least 85%, at least 90%, or at least 95% identical to a sequence in TABLE 38. In some instances, a guide nucleic acid comprises a sequence that is at least 70%, at least 75%, at least 80%, at least 85%, at least 90%, or at least 95% identical to any one of SEQ ID Nos: 630, 641, or 827-929. In some instances, a crRNA or a sgRNA comprises a sequence that is at least 70%, at least 75%, at least 80%, at least 85%, at least 90%, or at least 95% identical to any one of SEQ ID Nos: 630, 641, or 827-929. In some instances, guide nucleic acids comprise at least 8, at least 9, at least 10, at least 11, at least 12, at least 13, at least 14, at least 15, at least 16, at least 17, at least 18, at least 19, at least 20 at least 25, at least 30, or at least 35 contiguous nucleotides of a nucleotide sequence in TABLE 38.

TABLE 38

Examples Of Repeat Sequences Associated With Various Effector Proteins

| Associated Effector SEQ ID NO: | Type of Guide Nucleic Acid | Examples of Repeat Sequences | Seq ID NO |
|---|---|---|---|
| 1 | crRNA | CGUUGCAGCUCGCACGUUGGCACUGGUUGAAGG | 827 |
| 1 | crRNA | CGUUGCAGCUCGCACGUUGGCACUGGGUUGAAGG | 828 |
| 1 | SgRNA | UUGGCACUGGUUGAAGG | 829 |
| 1 | sgRNA | CACUGGUUGAAGG | 830 |
| 2 | crRNA | GUUGCAACUCACGCGCGUAUGUGGCUUGAAGG | 831 |
| 3 | crRNA | GUUGCAAUUCAUAUCUCCGGGUGGAUUGAAGG | 832 |
| 4 | sgRNA | AGCGUGUGGCUUGAAGG | 833 |
| 4 | sgRNA | UGUGGCUUGAAGG | 834 |
| 4, 10 | crRNA | GUUGCAGCGUGCGCGAGCGUGUGGCUUGAAGG | 835 |
| 5 | crRNA | GUUGCAACUCGCACGUGAAUGCGACUUGAAGG | 836 |
| 5 | sgRNA | UGAAUGCGACUUGAAGG | 837 |
| 6 | crRNA | GAUGCAACUCGUGUGUAUGUGCGAGUUGAAGG | 838 |
| 7 | crRNA | GACGCAACUCGCGCGCGGGCAUGUAUUGAGGG | 839 |
| 8 | crRNA | GAUGCAUCUGACACAGCUGGGUGAGUUGAAGG | 840 |
| 8 | sgRNA | GCUGGGUGAGUUGAAGG | 841 |
| 9 | crRNA | GUUGCAACACAUGUAUGUGGGUGAGUUGAAGG | 842 |
| 11 | crRNA | GUUGCAAUUUGUAUACGAGUGUGACUUGAAGG | 843 |
| 12 | crRNA | GCUGCAACACGCGCGGGUACGCGGGUUGAAGG | 844 |
| 13 | crRNA | GUUGCAACUCGCACGUUGGCACUGAUUGAAGG | 845 |
| 14 | crRNA | GCUGUAGCCCUGCUCAAAUUGUAGGGCGCAUGCAGG | 846 |
| 14, 15, 16 | crRNA | GUUGUAGUCGACCUGAAUCUGUGGGGUGCUUACAGG | 847 |
| 14, 16, 19 | sgRNA | UGUGGGGUGCUUACAGG | 848 |
| 16 | crRNA | GGUGUAUGUAACCGCAAUUUGAAGGGUGCAUACAGG | 849 |
| 17, 20 | crRNA | GUUGGAAUCGACCUUAAUUUGAGGUGUGCUUACAGG | 850 |
| 18 | crRNA | GCUGAAAGAGCAGAGAAUUUGUUGUGUGCAUACAGG | 851 |
| 19 | crRNA | GUUGGAGUCGGCUUGAAUCUGCGGGGUGCUUACAGG | 852 |

TABLE 38-continued

Examples Of Repeat Sequences Associated With Various Effector Proteins

| Associated Effector SEQ ID NO: | Type of Guide Nucleic Acid | Examples of Repeat Sequences | Seq ID NO |
|---|---|---|---|
| 21 | crRNA | GUUGUAAGAGACCCGAAUUUUAGCUGUGUAUACAGG | 853 |
| 22 | crRNA | GUUGUGAAUGCAGGCAUUUUUGAUGGUAAAUCCAAC | 854 |
| 22, 23, 24, 25, 26, 28, 29. 30, 31, 32, 33, 34, 207, 208, 217, 219, 222, 229, 236, 237, 238, | sgRNA | UGGUACAUCCAAC | 630 |
| 23 | crRNA | ACUGUCAGACAAUGCAAAAUGUGUGGUACAUCCAAC | 855 |
| 23 | sgRNA | UGGUACAUCC | 856 |
| 23 | sgRNA | UGGGGCAGUUGGUUGCCCUUAGCCUGAGGCAUUUAUUGCACUCGGGAAGUACCAUUACAUCCAAC | 857 |
| 23 | sgRNA | UGGUACAUCCAACUCUAGGCGCC | 858 |
| 23 | sgRNA | AAUGGUACAUCCAAC | 859 |
| 23 | sgRNA | UGGUACAUCCAACUCUAGGC | 860 |
| 23 | sgRNA | UGGUACAUCCAACUCUAGGCGC | 861 |
| 23 | sgRNA | UGGUACAUCCAACUCUAGGCG | 862 |
| 23 | sgRNA | UGGUACAUCCAACUCUAGG | 863 |
| 23 | sgRNA | AAAUGGUACAUCCAAC | 864 |
| 23 | sgRNA | UGGUACAUCCAACUCU | 865 |
| 23 | sgRNA | UGGUACAUCCAACUC | 866 |
| 23 | sgRNA | UGGUACAUCCAACU | 867 |
| 23 | sgRNA | UGGUACAUCCAACUCUAG | 868 |
| 23 | sgRNA | UGGUAUAUCCAAC | 869 |
| 23 | sgRNA | UGGUACAUCCAACUCUA | 870 |
| 23 | sgRNA | AUGGUACAUCCAAC | 871 |
| 23 | sgRNA | UGGUACAUCCAA | 872 |
| 23 | sgRNA | UGGUACAUCCA | 873 |
| 24, 34, 226 | crRNA | GCUGUCAGUAGUAGUAAAAAUGGGGGUACAUCCAAC | 874 |
| 25, 31 | crRNA | ACUGUCAGUACAUGCAAAAAUGAGGGUACAUCCAAC | 875 |
| 26 | crRNA | ACUGUCAGACAAUGCAAAAUGAGUGGUACAUCCAAC | 876 |
| 27 | crRNA | GCUGUUAGAACAUACAAAAUGAAAGGUACAUCCAAC | 877 |
| 28 | crRNA | GCUGCAUGUCAUGGCAAAAGGAAAGGUACAUCCAAC | 878 |
| 29 | crRNA | GCUGUCAGACACCUAAAAAAUGAGGGUACAUCCAAC | 879 |

TABLE 38-continued

Examples Of Repeat Sequences Associated With Various Effector Proteins

| Associated Effector SEQ ID NO: | Type of Guide Nucleic Acid | Examples of Repeat Sequences | Seq ID NO |
|---|---|---|---|
| 30, 32 | crRNA | GCUGUGAGUCACAGUAAAAAUGAAGGUAUAUCCAAC | 880 |
| 33 | crRNA | GAUGUAUAUGCUAUGAUUUUGUAUGGUACAUCCAAC | 881 |
| 34, 211, 230 | crRNA | GUUGCAGAACCCGAAUAGACGAAUGAAGGAAUGCAAC | 882 |
| 35 | crRNA | GUUGAGCUCUGCAUUACGCAGAUGAAUGACGAG | 883 |
| 35, 36, 38, 39, 41, 42, 43, 44, 212 | crRNA | GAUAUAUCUUGUAUGCAUAUGUAGGUUGUGAG | 884 |
| 35, 36, 38, 40, 41, 42, 43, 210 | SgRNA | GUUGCAACUUACGCAUAGGUGUAAAAUACGAGG | 885 |
| 36 | crRNA | GAUGCAACUUAGAUGCAUAUGUAAGUUGUGAG | 886 |
| 36, 37, 38, 41, 42, 43, 45 | crRNA | GUUGCAAUGAACGUAUGUGCAUGAGGUGUGAG | 887 |
| 36, 38, 42, 43, 234 | sgRNA | GUUGCAAUUCGUAUGCGCAGGUAAGUUUCGAG | 888 |
| 36, 37, 38, 42, 43, 45, | sgRNA | UGUGCAUGAGGUGUGAG | 889 |
| 37 | crRNA | GUUGCAAUCUGCGUACAGGCGUAAGAUGUGAG | 890 |
| 37 | sgRNA | CAGGCGUAAGAUGUGAG | 891 |
| 38, 43 | crRNA | GAUCAUAUCUGCUUGUAUGGGUAUGCUGCGAG | 892 |
| 38 | sgRNA | UAUGGGUAUGCUGCGAG | 893 |
| 39, 41 | crRNA | GUUGCAACUUACGCAUAGGUGUAAAAUACGAG | 894 |
| 40 | crRNA | GAUUAUAUCUGCUUGUAUGGGUAUACUGCGAG | 895 |
| 42 | crRNA | UCAGCUCACAACCUACAUAUGCAUACAAGAUAUAUCGU | 896 |
| 44 | sgRNA | CAUAUGUAGGUUGUGAG | 897 |
| 44 | sgRNA | UGUAGGUUGUGAG | 898 |
| 45 | sgRNA | CAUGAGGUGUGAG | 899 |
| 202, 205, 213, 233 | sgRNA | AGGUACAUCCAAC | 641 |
| 203, 209 | sgRNA | UGCGGUGUAAUUCGAGG | 900 |
| 204 | crRNA | GAUGUGAACGACCUUUUUUUGCGGUGUGCUUCGAGG | 901 |
| 206 | crRNA | GGUGGAUAUCAUCUUAAAAAGUGAGGUACAUCCAAC | 902 |
| 209 | crRNA | GGUGUGAACGACCUUUUUUUGCGGUGUAAUUCGAGG | 903 |
| 209 | sgRNA | UUGCGGUGUACUUCGAGG | 904 |
| 211 | sgRNA | AGAAGAAGGAUUGGGAC | 905 |
| 212 | crRNA | AAUGUGAACGACCUUCUUUUGCGGUGUACUUCGAGG | 906 |
| 214 | sgRNA | AAGGUUGAUACAGC | 907 |

TABLE 38-continued

Examples Of Repeat Sequences Associated With Various Effector Proteins

| Associated Effector SEQ ID NO: | Type of Guide Nucleic Acid | Examples of Repeat Sequences | Seq ID NO |
|---|---|---|---|
| 215 | crRNA | GCUGUAAGUCAUGGAAAAAUGGUGAGUACAUCCAAC | 908 |
| 215 | sgRNA | AUGGUGAGUACAUCCAAC | 909 |
| 216 | sgRNA | GAGCACAUCCAAC | 910 |
| 217 | sgRNA | GGGUACAUCCAAC | 911 |
| 218 | crRNA | GUUGCGUUUGCCCGUGAUUUCGGGUGUGUAUACAGG | 912 |
| 220 | sgRNA | AGGUAUAUCCAAC | 913 |
| 221 | crRNA | GGCGUAUGUCUACCUGAAAAAGAAGGUAUAUCCAAC | 914 |
| 223 | sgRNA | GGCUACAUACAGC | 915 |
| 224 | crRNA | GGUGUAUGUGCACCAUAUAUGUAGGUGACAUACAGC | 916 |
| 226, 235 | sgRNA | AAAACAAGGAUUGAAAC | 917 |
| 227 | crRNA | GAUGUGAACGACCUUUUUUUGCGGUGUACUUCGAGG | 918 |
| 227 | sgRNA | GUGUACUUCGAGG | 919 |
| 228 | crRNA | GAUGUAAAUCAUCUAUAAAAGAAAGGUACAUCCAAC | 920 |
| 228 | sgRNA | GGUACAUCCAAC | 921 |
| 230 | sgRNA | CGUACGUGGAUUGAAAC | 922 |
| 231 | crRNA | GCUGCACUGCACCGCCCAUUGAUGGUGUGCUCUAGG | 923 |
| 232 | crRNA | AUUGUAGGCGACCUUUUUUUGCGAUGUAGUUCGAGG | 924 |
| 232 | sgRNA | AUGUAGUUCGAGG | 925 |
| 233 | crRNA | AGUGUAUGAUUACCUGUAGUAUGAGGUACAUCCAAC | 926 |
| 239 | sgRNA | GCUGCAAGAGCUCCUAAUUUGAGGGGUGCAUACAGG | 927 |
| 240 | crRNA | GAUAGUUUUAACUUCCAUUUGAAAUGUAAAUGCAAC | 928 |
| 240 | sgRNA | AUGUAAAUGCAAC | 929 |

In some instances, a guide nucleic acid can comprise a nucleotide sequence as shown in TABLE 40. In some instances, a sgRNA comprises a repeat sequence as shown in TABLE 40. In some instances, a guide nucleic acid comprises a sequence that is at least 70%, at least 75%, at least 80%, at least 85%, at least 90%, or at least 95% identical to a sequence in TABLE 40. In some instances, a guide nucleic acid comprises a sequence that is at least 70%, at least 75%, at least 80%, at least 85%, at least 90%, or at least 95% identical to any one of SEQ ID Nos: 645, 932, 857, 933, 934, 935, 936, 737, 747, 750, 761, 763, 765, 769, 773, 780, 782, 785 or 941. In some instances, a sgRNA comprises a sequence that is at least 70%, at least 75%, at least 80%, at least 85%, at least 90%, or at least 95% identical to any one of SEQ ID Nos: 645, 932, 857, 933, 934, 935, 936, 737, 747, 750, 761, 763, 765, 769, 773, 780, 782, 785 or 941. In some instances, guide nucleic acids comprise at least 8, at least 9, at least 10, at least 11, at least 12, at least 13, at least 14, at least 15, at least 16, at least 17, at least 18, at least 19, at least 20 at least 25, at least 30, or at least 35 contiguous nucleotides of a nucleotide sequence in TABLE 40.

TABLE 40

Examples Of sgRNA Sequences

| sgRNA sequence | SEQ ID NO |
|---|---|
| UGGGGCAGUUGGUUGCCCUUAGCCUGAGGCAUUUAUUGCACUCGGGAAGUACCAUUUCUCAGAAAUGGUACAUCCAAC | 645 |
| UGGGGCAGUUGGUUGCCCUUAGCCUGAGGCAUUUAUUGCACUCGGGAAGUACCAUUUCUCAGAAAUGGUAUAUCCAAC | 932 |
| UGGGGCAGUUGGUUGCCCUUAGCCUGAGGCAUUUAUUGCACUCGGGAAGUACCAUUACAUCCAAC | 857 |
| AUGGGGCAGUUGGUUGCCCUUAGCCUGAGGCAUUUAAUGCACUCGGGAGAAAAAC | 933 |
| AUGGGGCAGUUGGUUGCCCUUAGCCUGAGGCAUUUAAUGCACUCGGGAAGUACCGAAAAUCCAAC | 934 |
| AUGGGGCAGUUGGUUGCCCUUAGCCUGAGGCAUUUAAUGCACUCGGGAAGUACCUUUUCUCAGAAAAGGUACAUCCAAC | 935 |
| AUGGGGCAGUUGGUUGCCCUUAGCCUGAGGCAUUUAAUGCACUCGGGAAGUACCUUUUCUCAGAAACCAAC | 936 |
| AAUAGGAUUUAUCCUAUGGGGCAGUUGGUUGCCCUUAGCCUGAGGCAUUUAUUGCACUCGGGAAGUACCUUAUUUCAUUGAGCAACAGAAAGGGUACAUCCAAC | 737 |
| GGGGCAGUUGGAUGCCCUUAUGCUGAGGGAUUAUUCCACUCGGCAAGUACCAAUAAUAAUGGAUGUGAAAAGGUACAUCCAAC | 747 |
| CGGGUGGUUGCACAUCCGAAGGGUGAGGAUUUAUUCACUCACUAAUACUACAAAUGGAAAAAUUUAAAGGAAAAUGUAAAUGCAAC | 750 |
| UGAAAUAUUGAUUGAGGUCGCCGUUUACGUUGCGUCACAAGGGCGCGCGGGCGACCGAAGGCCGAUCUGUACGGCCUGCAGGUUGAGAAGGCACAUAUUAGAGGAAAAUUGCUUCCCUUUGUGUUCGCUCACCGAGUAUUCCUUGUUAUUUGCGGCAAGAAACUGUCUUAAUUGUUUGAAAGGGUGCAUACAGG | 761 |
| AAGCAACCGCGUACACGCGGACGAACGGCCGACCUGCUCGGCCUGAAGGUUGAGAAGGUUAUGUAUAAGAGGAGAAAAUCCCCCUUCAUAAUCGCUCACCAAGCUCCCAAUUUACAUAUUUUGAAAGGGCGCAUGCAGG | 763 |
| UAUUGCGCUAGCCAUAAUGGCAAUCGCGUACAGGCAACUGAAGGCCGACCUGUACGGCCUUAAGGUUGAGAAGGCACAUGUAAGUGGAAAAAUGCUUUCCCGUUGUGUUCGCUCACCAAGCACACACGUUUGAAAUGUGGGGUGCUUACAGG | 765 |
| AGUAUGAGGCCGCCGAUAAACGUUUCGCUAGCCUGACAGGCAAUCGCGAACGGGCGGCUGAAGGCCGACCUGUACGGCCUGAAGGAUGAGAAGGCACAUAUAAGUGGAAAAUUGCUUCCCGUUGUGUUCGCUCACCAGGUACUCCUUAAUUUGAAAGCUGCAAGAGCUCCUAAUUUGAGGGGUGCAUACAGG | 769 |
| AACUGCCGGUAAGAUUACGAUAGCCGAAAGGCAAUUGCGUAUGCGGCAGUUAAGGCCGGCUCGAACGGCCUGAAGGUUGAGUUUAAAGUCACAUAUAAGCGGAAAAAUCAGAUUUCCCAUUGUGUUCGCUCACCAAUACGCGCAAAUUUGAAAAUGUAGUUCGAGG | 773 |
| ACCGAGGCCGCGAAAAACACAACGCUAGCCGAAAGGCAAUCGCGGGUGCGCGGCCGAAGGCCGACUAGAGCGGCCUGAAGGUUGAGAAGCGUGCAUGUAAACGGCAGAAAAAAUGCCUUUUGUACGCGCUCACCGAACACGUCUGAGCGGUUUGAAAGGUGUGCUCUAGG | 780 |
| GGGGUUGUUGGAAACCCUUAUGCUGAGGGAUUAUUCCACUCGGUAAGUACCUUAAAUAGUUAUAGAAAGAUGUAAAUCAUCUAUAAAAGAAAGGUACAUCCAAC | 782 |
| AAGAUAUGAAUAGGAGUAUUCCUAUGGGGCAGUUGGUUGCCCUUAGCCUGAGGUAUUUAAUGCACUCGGGAAGUACUUUCAACAGUAUCCGUUAGAAAAGGUACAUCCAAC | 785 |
| AUGAAUAGGAUUCGUCCUAUGGGGCAGUUGGUUGCCCUUAGCCUGAGGCAUUUAUUGCACUCGGGAAGUACCAUUUCUCAGAAAUGGUACAUCCAAC | 941 |

In some embodiments, a guide nucleic acid can comprise a nucleotide sequence that is shared among the exemplary guide nucleic acids described herein. For example, in some embodiments, a guide nucleic acid comprises a repeat sequence having the nucleotide sequence UGGUACAUCC (SEQ ID NO: 942). In some embodiments, a guide nucleic acid comprises a repeat sequence that is at least 70%, at least 75%, at least 80%, at least 85%, at least 90%, or at least 95% identical to UGGUACAUCC (SEQ ID NO: 942). Such a repeat sequence includes, for example, the nucleotide sequence of UGGUAUAUCC (SEQ ID NO: 943).

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 46; and a tracrRNA comprising a nucleobase sequence that is at least 70%, at least 75%, at least 80%, at least 85%, at least 90%, at least 95%, or 100% identical to SEQ ID NO: 91. In some instances, effector protein comprises an amino acid sequence that is at least 70%, at least 75%, at least 80%, at least 85%, at least 90%, at least 95%, at least 99%, or 100% identical to SEQ ID NO: 1. In some instances, the amino acid sequence of the effector protein is at least 70%, at least 75%, at least 80%, at least 85%, at least 90%, at least 95%, at least 99%, or 100% identical to SEQ ID NO: 1. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 47; and a tracrRNA comprising a nucleobase sequence that is at least 70%, at least 75%, at least 80%, at least 85%, at least 90%, at least 95%, or 100% identical to SEQ ID NO: 92. In some instances, effector protein comprises an amino acid sequence that is at least 70%, at least 75%, at least 80%, at least 85%, at least 90%, at least 95%, at least 99%, or 100% identical to SEQ ID NO: 2. In some instances, the amino acid sequence of the effector protein is at least 70%, at least 75%, at least 80%, at least 85%, at least 90%, at least 95%, at least 99%, or 100% identical to SEQ ID NO: 2. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 48; and a tracrRNA comprising a nucleobase sequence that is at least 70%, at least 75%, at least 80%, at least 85%, at least 90%, at least 95%, or 100% identical to SEQ ID NO: 93. In some instances, effector protein comprises an amino acid sequence that is at least 70%, at least 75%, at least 80%, at least 85%, at least 90%, at least 95%, at least 99%, or 100% identical to SEQ ID NO: 3. In some instances, the amino acid sequence of the effector protein is at least 70%, at least 75%, at least 80%, at least 85%, at least 90%, at least 95%, at least 99%, or 100% identical to SEQ ID NO: 3. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 49; and a tracrRNA comprising a nucleobase sequence that is at least 70%, at least 75%, at least 80%, at least 85%, at least 90%, at least 95%, or 100% identical to SEQ ID NO: 94. In some instances, effector protein comprises an amino acid sequence that is at least 70%, at least 75%, at least 80%, at least 85%, at least 90%, at least 95%, at least 99%, or 100% identical to SEQ ID NO: 4. In some instances, the amino acid sequence of the effector protein is at least 70%, at least 75%, at least 80%, at least 85%, at least 90%, at least 95%, at least 99%, or 100% identical to SEQ ID NO: 4. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 50; and a tracrRNA comprising a nucleobase sequence that is at least 70%, at least 75%, at least 80%, at least 85%, at least 90%, at least 95%, or 100% identical to SEQ ID NO: 95. In some instances, effector protein comprises an amino acid sequence that is at least 70%, at least 75%, at least 80%, at least 85%, at least 90%, at least 95%, at least 99%, or 100% identical to SEQ ID NO: 5. In some instances, the amino acid sequence of the effector protein is at least 70%, at least 75%, at least 80%, at least 85%, at least 90%, at least 95%, at least 99%, or 100% identical to SEQ ID NO: 5. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 51; and a tracrRNA comprising a nucleobase sequence that is at least 70%, at least 75%, at least 80%, at least 85%, at least 90%, at least 95%, or 100% identical to SEQ ID NO: 96. In some instances, effector protein comprises an amino acid sequence that is at least 70%, at least 75%, at least 80%, at least 85%, at least 90%, at least 95%, at least 99%, or 100% identical to SEQ ID NO: 6. In some instances, the amino acid sequence of the effector protein is at least 70%, at least 75%, at least 80%, at least 85%, at least 90%, at least 95%, at least 99%, or 100% identical to SEQ ID NO: 6. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 52; and a tracrRNA comprising a nucleobase sequence that is at least 70%, at least 75%, at least 80%, at least 85%, at least 90%, at least 95%, or 100% identical to SEQ ID NO: 97. In some instances, effector protein comprises an amino acid sequence that is at least 70%, at least 75%, at least 80%, at least 85%, at least 90%, at least 95%, at least 99%, or 100% identical to SEQ ID NO: 7. In some instances, the amino acid sequence of the effector protein is at least 70%, at least 75%, at least 80%, at least 85%, at least 90%, at least 95%, at least 99%, or 100% identical to SEQ ID NO: 7. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 53; and a tracrRNA comprising a nucleobase sequence that is at least 70%, at least 75%, at least 80%, at least 85%, at least 90%, at least 95%, or 100% identical to SEQ ID NO: 98. In some instances, effector protein comprises an amino acid sequence that is at least 70%, at least 75%, at least 80%, at least 85%, at least 90%, at least 95%, at least 99%, or 100% identical to SEQ ID NO: 8. In some instances, the amino acid sequence of the effector protein is at least 70%, at least 75%, at least 80%, at least 85%, at least 90%, at least 95%, at least 99%, or 100% identical to SEQ ID NO: 8. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 54; and a tracrRNA comprising a nucleobase sequence that is at least 70%, at least 75%, at least 80%, at least 85%, at least 90%, at least 95%, or 100% identical to SEQ ID NO: 99. In some instances, effector protein comprises an amino acid sequence that is at least 70%, at least 75%, at least 80%, at least 85%, at least 90%, at least 95%, at least 99%, or 100% identical to SEQ ID NO: 9. In some instances, the amino acid sequence of the effector protein is at least 70%, at least 75%, at least 80%, at least 85%, at least 90%, at least 95%, at least 99%, or 100% identical to SEQ ID NO: 9. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 55; and a tracrRNA comprising a nucleobase sequence that is at least 70%, at least 75%, at least 80%, at least 85%, at least 90%, at least 95%, or 100% identical to SEQ ID NO: 100. In some instances, effector protein comprises an amino acid sequence that is at least 70%, at least 75%, at least 80%, at least 85%, at least 90%, at least 95%, at least 99%, or 100% identical to SEQ ID NO: 10. In some instances, the amino acid sequence of the effector protein is at least 70%, at least 75%, at least 80%, at least 85%, at least 90%, at least 95%, at least 99%, or 100% identical to SEQ ID NO: 10. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 56; and a tracrRNA comprising a nucleobase sequence that is at least 70%, at least 75%, at least 80%, at least 85%, at least 90%, at least 95%, or 100% identical to SEQ ID NO: 101. In some instances, effector protein comprises an amino acid sequence that is at least 70%, at least 75%, at least 80%, at least 85%, at least 90%, at least 95%, at least 99%, or 100% identical to SEQ ID NO: 11. In some instances, the amino acid sequence of the effector protein is at least 70%, at least 75%, at least 80%, at least 85%, at least 90%, at least 95%, at least 99%, or 100% identical to SEQ ID NO: 11. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 57; and a tracrRNA comprising a nucleobase sequence that is at least 70%, at least 75%, at least 80%, at least 85%, at least 90%, at least 95%, or 100% identical to SEQ ID NO: 102. In some instances, effector protein comprises an amino acid sequence that is at least 70%, at least 75%, at least 80%, at least 85%, at least 90%, at least 95%, at least 99%, or 100% identical to SEQ ID NO: 12. In some instances, the amino acid sequence of the effector protein is at least 70%, at least 75%, at least 80%, at least 85%, at least 90%, at least 95%, at least 99%, or 100% identical to SEQ ID NO: 12. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 1-13; a crRNA comprising a nucleobase sequence that is at least 70%, at least 75%, at least 80%, at least 85%, at least 90%, at least 95%, or 100% identical to SEQ ID NO: 58; and a tracrRNA comprising a nucleobase sequence that is at least 70%, at least 75%, at least 80%, at least 85%, at least 90%, at least 95%, or 100% identical to SEQ ID NO: 103. In some instances, effector protein comprises an amino acid sequence that is at least 70%, at least 75%, at least 80%, at least 85%, at least 90%, at least 95%, at least 99%, or 100% identical to SEQ ID NO: 13. In some instances, the amino acid sequence of the effector protein is at least 70%, at least 75%, at least 80%, at least 85%, at least 90%, at least 95%, at least 99%, or 100% identical to SEQ ID NO: 13. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 59; and a tracrRNA comprising a nucleobase sequence that is at least 70%, at least 75%, at least 80%, at least 85%, at least 90%, at least 95%, or 100% identical to SEQ ID NO: 104. In some instances, effector protein comprises an amino acid sequence that is at least 70%, at least 75%, at least 80%, at least 85%, at least 90%, at least 95%, at least 99%, or 100% identical to SEQ ID NO: 14. In some instances, the amino acid sequence of the effector protein is at least 70%, at least 75%, at least 80%, at least 85%, at least 90%, at least 95%, at least 99%, or 100% identical to SEQ ID NO: 14. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 59; and a tracrRNA comprising a nucleobase sequence that is at least 70%, at least 75%, at least 80%, at least 85%, at least 90%, at least 95%, or 100% identical to SEQ ID NO: 105. In some instances, effector protein comprises an amino acid sequence that is at least 70%, at least 75%, at least 80%, at least 85%, at least 90%, at least 95%, at least 99%, or 100% identical to SEQ ID NO: 14. In some instances, the amino acid sequence of the effector protein is at least 70%, at least 75%, at least 80%, at least 85%, at least 90%, at least 95%, at least 99%, or 100% identical to SEQ ID NO: 14. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 60; and a tracrRNA comprising a nucleobase sequence that is at least 70%, at least 75%, at least 80%, at least 85%, at least 90%, at least 95%, or 100% identical to SEQ ID NO: 106. In some instances, effector protein comprises an amino acid sequence that is at least 70%, at least 75%, at least 80%, at least 85%, at least 90%, at least 95%, at least 99%, or 100% identical to SEQ ID NO: 15. In some instances, the amino acid sequence of the effector protein is at least 70%, at least 75%, at least 80%, at least 85%, at least 90%, at least 95%, at least 99%, or 100% identical to SEQ ID NO: 15. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 60; and a tracrRNA comprising a nucleobase sequence that is at least 70%, at least 75%, at least 80%, at least 85%, at least 90%, at least 95%, or 100% identical to SEQ ID NO: 107. In some instances, effector protein comprises an amino acid sequence that is at least 70%, at least 75%, at least 80%, at least 85%, at least 90%, at least 95%, at least 99%, or 100% identical to SEQ ID NO: 15. In some instances, the amino acid sequence of the effector protein is at least 70%, at least 75%, at least 80%, at least 85%, at least 90%, at least 95%, at least 99%, or 100% identical to SEQ ID NO: 15. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 61; and a tracrRNA comprising a nucleobase sequence that is at least 70%, at least 75%, at least 80%, at least 85%, at least 90%, at least 95%, or 100% identical to SEQ ID NO: 108. In some instances, effector protein comprises an amino acid sequence that is at least 70%, at least 75%, at least 80%, at least 85%, at least 90%, at least 95%, at least 99%, or 100% identical to SEQ ID NO: 16. In some instances, the amino acid sequence of the effector protein is at least 70%, at least 75%, at least 80%, at least 85%, at least 90%, at least 95%, at least 99%, or 100% identical to SEQ ID NO: 16. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 61; and a tracrRNA comprising a nucleobase sequence that is at least 70%, at least 75%, at least 80%, at least 85%, at least 90%, at least 95%, or 100% identical to SEQ ID NO: 109. In some instances, effector protein comprises an amino acid sequence that is at least 70%, at least 75%, at least 80%, at least 85%, at least 90%, at least 95%, at least 99%, or 100% identical to SEQ ID NO: 16. In some instances, the amino acid sequence of the effector protein is at least 70%, at least 75%, at least 80%, at least 85%, at least 90%, at least 95%, at least 99%, or 100% identical to SEQ ID NO: 16. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 62; and a tracrRNA comprising a nucleobase sequence that is at least 70%, at least 75%, at least 80%, at least 85%, at least 90%, at least 95%, or 100% identical to SEQ ID NO: 110. In some instances, effector protein comprises an amino acid sequence that is at least 70%, at least 75%, at least 80%, at least 85%, at least 90%, at least 95%, at least 99%, or 100% identical to SEQ ID NO: 17. In some instances, the amino acid sequence of the effector protein is at least 70%, at least 75%, at least 80%, at least 85%, at least 90%, at least 95%, at least 99%, or 100% identical to SEQ ID NO: 17. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 62; and a tracrRNA comprising a nucleobase sequence that is at least 70%, at least 75%, at least 80%, at least 85%, at least 90%, at least 95%, or 100% identical to SEQ ID NO: 111. In some instances, effector protein comprises an amino acid sequence that is at least 70%, at least 75%, at least 80%, at least 85%, at least 90%, at least 95%, at least 99%, or 100% identical to SEQ ID NO: 17. In some instances, the amino acid sequence of the effector protein is at least 70%, at least 75%, at least 80%, at least 85%, at least 90%, at least 95%, at least 99%, or 100% identical to SEQ ID NO: 17. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 63; and a tracrRNA comprising a nucleobase sequence that is at least 70%, at least 75%, at least 80%, at least 85%, at least 90%, at least 95%, or 100% identical to SEQ ID NO: 112. In some instances, effector protein comprises an amino acid sequence that is at least 70%, at least 75%, at least 80%, at least 85%, at least 90%, at least 95%, at least 99%, or 100% identical to SEQ ID NO: 18. In some instances, the amino acid sequence of the effector protein is at least 70%, at least 75%, at least 80%, at least 85%, at least 90%, at least 95%, at least 99%, or 100% identical to SEQ ID NO: 18. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 63; and a tracrRNA comprising a nucleobase sequence that is at least 70%, at least 75%, at least 80%, at least 85%, at least 90%, at least 95%, or 100% identical to SEQ ID NO: 113. In some instances, effector protein comprises an amino acid sequence that is at least 70%, at least 75%, at least 80%, at least 85%, at least 90%, at least 95%, at least 99%, or 100% identical to SEQ ID NO: 18. In some instances, the amino acid sequence of the effector protein is at least 70%, at least 75%, at least 80%, at least 85%, at least 90%, at least 95%, at least 99%, or 100% identical to SEQ ID NO: 18. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 64; and a tracrRNA comprising a nucleobase sequence that is at least 70%, at least 75%, at least 80%, at least 85%, at least 90%, at least 95%, or 100% identical to SEQ ID NO: 114. In some instances, effector protein comprises an amino acid sequence that is at least 70%, at least 75%, at least 80%, at least 85%, at least 90%, at least 95%, at least 99%, or 100% identical to SEQ ID NO: 19. In some instances, the amino acid sequence of the effector protein is at least 70%, at least 75%, at least 80%, at least 85%, at least 90%, at least 95%, at least 99%, or 100% identical to SEQ ID NO: 19. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 64; and a tracrRNA comprising a nucleobase sequence that is at least 70%, at least 75%, at least 80%, at least 85%, at least 90%, at least 95%, or 100% identical to SEQ ID NO: 115. In some instances, effector protein comprises an amino acid sequence that is at least 70%, at least 75%, at least 80%, at least 85%, at least 90%, at least 95%, at least 99%, or 100% identical to SEQ ID NO: 19. In some instances, the amino acid sequence of the effector protein is at least 70%, at least 75%, at least 80%, at least 85%, at least 90%, at least 95%, at least 99%, or 100% identical to SEQ ID NO: 19. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 65; and a tracrRNA comprising a nucleobase sequence that is at least 70%, at least 75%, at least 80%, at least 85%, at least 90%, at least 95%, or 100% identical to SEQ ID NO: 116. In some instances, effector protein comprises an amino acid sequence that is at least 70%, at least 75%, at least 80%, at least 85%, at least 90%, at least 95%, at least 99%, or 100% identical to SEQ ID NO: 20. In some instances, the amino acid sequence of the effector protein is at least 70%, at least 75%, at least 80%, at least 85%, at least 90%, at least 95%, at least 99%, or 100% identical to SEQ ID NO: 20. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 65; and a tracrRNA comprising a nucleobase sequence that is at least 70%, at least 75%, at least 80%, at least 85%, at least 90%, at least 95%, or 100% identical to SEQ ID NO: 117. In some instances, effector protein comprises an amino acid sequence that is at least 70%, at least 75%, at least 80%, at least 85%, at least 90%, at least 95%, at least 99%, or 100% identical to SEQ ID NO: 20. In some instances, the amino acid sequence of the effector protein is at least 70%, at least 75%, at least 80%, at least 85%, at least 90%, at least 95%, at least 99%, or 100% identical to SEQ ID NO: 20. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 66; and a tracrRNA comprising a nucleobase sequence that is at least 70%, at least 75%, at least 80%, at least 85%, at least 90%, at least 95%, or 100% identical to SEQ ID NO: 118. In some instances, effector protein comprises an amino acid sequence that is at least 70%, at least 75%, at least 80%, at least 85%, at least 90%, at least 95%, at least 99%, or 100% identical to SEQ ID NO: 21. In some instances, the amino acid sequence of the effector protein is at least 70%, at least 75%, at least 80%, at least 85%, at least 90%, at least 95%, at least 99%, or 100% identical to SEQ ID NO: 21. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 14-21; a crRNA comprising a nucleobase sequence that is at least 70%, at least 75%, at least 80%, at least 85%, at least 90%, at least 95%, or 100% identical to SEQ ID NO: 66; and a tracrRNA comprising a nucleobase sequence that is at least 70%, at least 75%, at least 80%, at least 85%, at least 90%, at least 95%, or 100% identical to SEQ ID NO: 119. In some instances, effector protein comprises an amino acid sequence that is at least 70%, at least 75%, at least 80%, at least 85%, at least 90%, at least 95%, at least 99%, or 100% identical to SEQ ID NO: 21. In some instances, the amino acid sequence of the effector protein is at least 70%, at least 75%, at least 80%, at least 85%, at least 90%, at least 95%, at least 99%, or 100% identical to SEQ ID NO: 21. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 67; and a tracrRNA comprising a nucleobase sequence that is at least 70%, at least 75%, at least 80%, at least 85%, at least 90%, at least 95%, or 100% identical to SEQ ID NO: 120. In some instances, effector protein comprises an amino acid sequence that is at least 70%, at least 75%, at least 80%, at least 85%, at least 90%, at least 95%, at least 99%, or 100% identical to SEQ ID NO: 22. In some instances, the amino acid sequence of the effector protein is at least 70%, at least 75%, at least 80%, at least 85%, at least 90%, at least 95%, at least 99%, or 100% identical to SEQ ID NO: 22. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 68; and a tracrRNA comprising a nucleobase sequence that is at least 70%, at least 75%, at least 80%, at least 85%, at least 90%, at least 95%, or 100% identical to SEQ ID NO: 120. In some instances, effector protein comprises an amino acid sequence that is at least 70%, at least 75%, at least 80%, at least 85%, at least 90%, at least 95%, at least 99%, or 100% identical to SEQ ID NO: 23. In some instances, the amino acid sequence of the effector protein is at least 70%, at least 75%, at least 80%, at least 85%, at least 90%, at least 95%, at least 99%, or 100% identical to SEQ ID NO: 23. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 69; and a tracrRNA comprising a nucleobase sequence that is at least 70%, at least 75%, at least 80%, at least 85%, at least 90%, at least 95%, or 100% identical to SEQ ID NO: 121. In some instances, effector protein comprises an amino acid sequence that is at least 70%, at least 75%, at least 80%, at least 85%, at least 90%, at least 95%, at least 99%, or 100% identical to SEQ ID NO: 24. In some instances, the amino acid sequence of the effector protein is at least 70%, at least 75%, at least 80%, at least 85%, at least 90%, at least 95%, at least 99%, or 100% identical to SEQ ID NO: 24. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 70; and a tracrRNA comprising a nucleobase sequence that is at least 70%, at least 75%, at least 80%, at least 85%, at least 90%, at least 95%, or 100% identical to SEQ ID NO: 122. In some instances, effector protein comprises an amino acid sequence that is at least 70%, at least 75%, at least 80%, at least 85%, at least 90%, at least 95%, at least 99%, or 100% identical to SEQ ID NO: 25. In some instances, the amino acid sequence of the effector protein is at least 70%, at least 75%, at least 80%, at least 85%, at least 90%, at least 95%, at least 99%, or 100% identical to SEQ ID NO: 25. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 71; and a tracrRNA comprising a nucleobase sequence that is at least 70%, at least 75%, at least 80%, at least 85%, at least 90%, at least 95%, or 100% identical to SEQ ID NO: 120. In some instances, effector protein comprises an amino acid sequence that is at least 70%, at least 75%, at least 80%, at least 85%, at least 90%, at least 95%, at least 99%, or 100% identical to SEQ ID NO: 26. In some instances, the amino acid sequence of the effector protein is at least 70%, at least 75%, at least 80%, at least 85%, at least 90%, at least 95%, at least 99%, or 100% identical to SEQ ID NO: 26. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 72; and a tracrRNA comprising a nucleobase sequence that is at least 70%, at least 75%, at least 80%, at least 85%, at least 90%, at least 95%, or 100% identical to SEQ ID NO: 123. In some instances, effector protein comprises an amino acid sequence that is at least 70%, at least 75%, at least 80%, at least 85%, at least 90%, at least 95%, at least 99%, or 100% identical to SEQ ID NO: 27. In some instances, the amino acid sequence of the effector protein is at least 70%, at least 75%, at least 80%, at least 85%, at least 90%, at least 95%, at least 99%, or 100% identical to SEQ ID NO: 27. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 73; and a tracrRNA comprising a nucleobase sequence that is at least 70%, at least 75%, at least 80%, at least 85%, at least 90%, at least 95%, or 100% identical to SEQ ID NO: 121. In some instances, effector protein comprises an amino acid sequence that is at least 70%, at least 75%, at least 80%, at least 85%, at least 90%, at least 95%, at least 99%, or 100% identical to SEQ ID NO: 28. In some instances, the amino acid sequence of the effector protein is at least 70%, at least 75%, at least 80%, at least 85%, at least 90%, at least 95%, at least 99%, or 100% identical to SEQ ID NO: 28. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 74; and a tracrRNA comprising a nucleobase sequence that is at least 70%, at least 75%, at least 80%, at least 85%, at least 90%, at least 95%, or 100% identical to SEQ ID NO: 121. In some instances, effector protein comprises an amino acid sequence that is at least 70%, at least 75%, at least 80%, at least 85%, at least 90%, at least 95%, at least 99%, or 100% identical to SEQ ID NO: 29. In some instances, the amino acid sequence of the effector protein is at least 70%, at least 75%, at least 80%, at least 85%, at least 90%, at least 95%, at least 99%, or 100% identical to SEQ ID NO: 29. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 75; and a tracrRNA comprising a nucleobase sequence that is at least 70%, at least 75%, at least 80%, at least 85%, at least 90%, at least 95%, or 100% identical to SEQ ID NO: 124. In some instances, effector protein comprises an amino acid sequence that is at least 70%, at least 75%, at least 80%, at least 85%, at least 90%, at least 95%, at least 99%, or 100% identical to SEQ ID NO: 30. In some instances, the amino acid sequence of the effector protein is at least 70%, at least 75%, at least 80%, at least 85%, at least 90%, at least 95%, at least 99%, or 100% identical to SEQ ID NO: 30. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 76; and a tracrRNA comprising a nucleobase sequence that is at least 70%, at least 75%, at least 80%, at least 85%, at least 90%, at least 95%, or 100% identical to SEQ ID NO: 122. In some instances, effector protein comprises an amino acid sequence that is at least 70%, at least 75%, at least 80%, at least 85%, at least 90%, at least 95%, at least 99%, or 100% identical to SEQ ID NO: 31. In some instances, the amino acid sequence of the effector protein is at least 70%, at least 75%, at least 80%, at least 85%, at least 90%, at least 95%, at least 99%, or 100% identical to SEQ ID NO: 31. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 77; and a tracrRNA comprising a nucleobase sequence that is at least 70%, at least 75%, at least 80%, at least 85%, at least 90%, at least 95%, or 100% identical to SEQ ID NO: 124. In some instances, effector protein comprises an amino acid sequence that is at least 70%, at least 75%, at least 80%, at least 85%, at least 90%, at least 95%, at least 99%, or 100% identical to SEQ ID NO: 32. In some instances, the amino acid sequence of the effector protein is at least 70%, at least 75%, at least 80%, at least 85%, at least 90%, at least 95%, at least 99%, or 100% identical to SEQ ID NO: 32. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 78; and a tracrRNA comprising a nucleobase sequence that is at least 70%, at least 75%, at least 80%, at least 85%, at least 90%, at least 95%, or 100% identical to SEQ ID NO: 125. In some instances, effector protein comprises an amino acid sequence that is at least 70%, at least 75%, at least 80%, at least 85%, at least 90%, at least 95%, at least 99%, or 100% identical to SEQ ID NO: 33. In some instances, the amino acid sequence of the effector protein is at least 70%, at least 75%, at least 80%, at least 85%, at least 90%, at least 95%, at least 99%, or 100% identical to SEQ ID NO: 33. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 78; and a tracrRNA comprising a nucleobase sequence that is at least 70%, at least 75%, at least 80%, at least 85%, at least 90%, at least 95%, or 100% identical to SEQ ID NO: 126. In some instances, effector protein comprises an amino acid sequence that is at least 70%, at least 75%, at least 80%, at least 85%, at least 90%, at least 95%, at least 99%, or 100% identical to SEQ ID NO: 33. In some instances, the amino acid sequence of the effector protein is at least 70%, at least 75%, at least 80%, at least 85%, at least 90%, at least 95%, at least 99%, or 100% identical to SEQ ID NO: 33. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; a crRNA comprising a nucleobase sequence that is at least 70%, at least 75%, at least 80%, at least 85%, at least 90%, at least 95%, or 100% identical to SEQ ID NO: 79; and a tracrRNA comprising a nucleobase sequence that is at least 70%, at least 75%, at least 80%, at least 85%, at least 90%, at least 95%, or 100% identical to SEQ ID NO: 127. In some instances, effector protein comprises an amino acid sequence that is at least 70%, at least 75%, at least 80%, at least 85%, at least 90%, at least 95%, at least 99%, or 100% identical to SEQ ID NO: 34. In some instances, the amino acid sequence of the effector protein is at least 70%, at least 75%, at least 80%, at least 85%, at least 90%, at least 95%, at least 99%, or 100% identical to SEQ ID NO: 34. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 80; and a tracrRNA comprising a nucleobase sequence that is at least 70%, at least 75%, at least 80%, at least 85%, at least 90%, at least 95%, or 100% identical to SEQ ID NO: 128. In some instances, effector protein comprises an amino acid sequence that is at least 70%, at least 75%, at least 80%, at least 85%, at least 90%, at least 95%, at least 99%, or 100% identical to SEQ ID NO: 35. In some instances, the amino acid sequence of the effector protein is at least 70%, at least 75%, at least 80%, at least 85%, at least 90%, at least 95%, at least 99%, or 100% identical to SEQ ID NO: 35. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 80; and a tracrRNA comprising a nucleobase sequence that is at least 70%, at least 75%, at least 80%, at least 85%, at least 90%, at least 95%, or 100% identical to SEQ ID NO: 129. In some instances, effector protein comprises an amino acid sequence that is at least 70%, at least 75%, at least 80%, at least 85%, at least 90%, at least 95%, at least 99%, or 100% identical to SEQ ID NO: 35. In some instances, the amino acid sequence of the effector protein is at least 70%, at least 75%, at least 80%, at least 85%, at least 90%, at least 95%, at least 99%, or 100% identical to SEQ ID NO: 35. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 81; and a tracrRNA comprising a nucleobase sequence that is at least 70%, at least 75%, at least 80%, at least 85%, at least 90%, at least 95%, or 100% identical to SEQ ID NO: 130. In some instances, effector protein comprises an amino acid sequence that is at least 70%, at least 75%, at least 80%, at least 85%, at least 90%, at least 95%, at least 99%, or 100% identical to SEQ ID NO: 36. In some instances, the amino acid sequence of the effector protein is at least 70%, at least 75%, at least 80%, at least 85%, at least 90%, at least 95%, at least 99%, or 100% identical to SEQ ID NO: 36. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 81; and a tracrRNA comprising a nucleobase sequence that is at least 70%, at least 75%, at least 80%, at least 85%, at least 90%, at least 95%, or 100% identical to SEQ ID NO: 131. In some instances, effector protein comprises an amino acid sequence that is at least 70%, at least 75%, at least 80%, at least 85%, at least 90%, at least 95%, at least 99%, or 100% identical to SEQ ID NO: 36. In some instances, the amino acid sequence of the effector protein is at least 70%, at least 75%, at least 80%, at least 85%, at least 90%, at least 95%, at least 99%, or 100% identical to SEQ ID NO: 36. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 82; and a tracrRNA comprising a nucleobase sequence that is at least 70%, at least 75%, at least 80%, at least 85%, at least 90%, at least 95%, or 100% identical to SEQ ID NO: 132. In some instances, effector protein comprises an amino acid sequence that is at least 70%, at least 75%, at least 80%, at least 85%, at least 90%, at least 95%, at least 99%, or 100% identical to SEQ ID NO: 37. In some instances, the amino acid sequence of the effector protein is at least 70%, at least 75%, at least 80%, at least 85%, at least 90%, at least 95%, at least 99%, or 100% identical to SEQ ID NO: 37. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 82; and a tracrRNA comprising a nucleobase sequence that is at least 70%, at least 75%, at least 80%, at least 85%, at least 90%, at least 95%, or 100% identical to SEQ ID NO: 133. In some instances, effector protein comprises an amino acid sequence that is at least 70%, at least 75%, at least 80%, at least 85%, at least 90%, at least 95%, at least 99%, or 100% identical to SEQ ID NO: 37. In some instances, the amino acid sequence of the effector protein is at least 70%, at least 75%, at least 80%, at least 85%, at least 90%, at least 95%, at least 99%, or 100% identical to SEQ ID NO: 37. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 83; and a tracrRNA comprising a nucleobase sequence that is at least 70%, at least 75%, at least 80%, at least 85%, at least 90%, at least 95%, or 100% identical to SEQ ID NO: 134. In some instances, effector protein comprises an amino acid sequence that is at least 70%, at least 75%, at least 80%, at least 85%, at least 90%, at least 95%, at least 99%, or 100% identical to SEQ ID NO: 38. In some instances, the amino acid sequence of the effector protein is at least 70%, at least 75%, at least 80%, at least 85%, at least 90%, at least 95%, at least 99%, or 100% identical to SEQ ID NO: 38. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 83; and a tracrRNA comprising a nucleobase sequence that is at least 70%, at least 75%, at least 80%, at least 85%, at least 90%, at least 95%, or 100% identical to SEQ ID NO: 135. In some instances, effector protein comprises an amino acid sequence that is at least 70%, at least 75%, at least 80%, at least 85%, at least 90%, at least 95%, at least 99%, or 100% identical to SEQ ID NO: 38. In some instances, the amino acid sequence of the effector protein is at least 70%, at least 75%, at least 80%, at least 85%, at least 90%, at least 95%, at least 99%, or 100% identical to SEQ ID NO: 38. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 84; and a tracrRNA comprising a nucleobase sequence that is at least 70%, at least 75%, at least 80%, at least 85%, at least 90%, at least 95%, or 100% identical to SEQ ID NO: 136. In some instances, effector protein comprises an amino acid sequence that is at least 70%, at least 75%, at least 80%, at least 85%, at least 90%, at least 95%, at least 99%, or 100% identical to SEQ ID NO: 39. In some instances, the amino acid sequence of the effector protein is at least 70%, at least 75%, at least 80%, at least 85%, at least 90%, at least 95%, at least 99%, or 100% identical to SEQ ID NO: 39. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 84; and a tracrRNA comprising a nucleobase sequence that is at least 70%, at least 75%, at least 80%, at least 85%, at least 90%, at least 95%, or 100% identical to SEQ ID NO: 137. In some instances, effector protein comprises an amino acid sequence that is at least 70%, at least 75%, at least 80%, at least 85%, at least 90%, at least 95%, at least 99%, or 100% identical to SEQ ID NO: 39. In some instances, the amino acid sequence of the effector protein is at least 70%, at least 75%, at least 80%, at least 85%, at least 90%, at least 95%, at least 99%, or 100% identical to SEQ ID NO: 39. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 85; and a tracrRNA comprising a nucleobase sequence that is at least 70%, at least 75%, at least 80%, at least 85%, at least 90%, at least 95%, or 100% identical to SEQ ID NO: 138. In some instances, effector protein comprises an amino acid sequence that is at least 70%, at least 75%, at least 80%, at least 85%, at least 90%, at least 95%, at least 99%, or 100% identical to SEQ ID NO: 40. In some instances, the amino acid sequence of the effector protein is at least 70%, at least 75%, at least 80%, at least 85%, at least 90%, at least 95%, at least 99%, or 100% identical to SEQ ID NO: 40. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 86; and a tracrRNA comprising a nucleobase sequence that is at least 70%, at least 75%, at least 80%, at least 85%, at least 90%, at least 95%, or 100% identical to SEQ ID NO: 139. In some instances, effector protein comprises an amino acid sequence that is at least 70%, at least 75%, at least 80%, at least 85%, at least 90%, at least 95%, at least 99%, or 100% identical to SEQ ID NO: 41. In some instances, the amino acid sequence of the effector protein is at least 70%, at least 75%, at least 80%, at least 85%, at least 90%, at least 95%, at least 99%, or 100% identical to SEQ ID NO: 41. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 86; and a tracrRNA comprising a nucleobase sequence that is at least 70%, at least 75%, at least 80%, at least 85%, at least 90%, at least 95%, or 100% identical to SEQ ID NO: 140. In some instances, effector protein comprises an amino acid sequence that is at least 70%, at least 75%, at least 80%, at least 85%, at least 90%, at least 95%, at least 99%, or 100% identical to SEQ ID NO: 41. In some instances, the amino acid sequence of the effector protein is at least 70%, at least 75%, at least 80%, at least 85%, at least 90%, at least 95%, at least 99%, or 100% identical to SEQ ID NO: 41. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 87; and a tracrRNA comprising a nucleobase sequence that is at least 70%, at least 75%, at least 80%, at least 85%, at least 90%, at least 95%, or 100% identical to SEQ ID NO: 141. In some instances, effector protein comprises an amino acid sequence that is at least 70%, at least 75%, at least 80%, at least 85%, at least 90%, at least 95%, at least 99%, or 100% identical to SEQ ID NO: 42. In some instances, the amino acid sequence of the effector protein is at least 70%, at least 75%, at least 80%, at least 85%, at least 90%, at least 95%, at least 99%, or 100% identical to SEQ ID NO: 42. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 87; and a tracrRNA comprising a nucleobase sequence that is at least 70%, at least 75%, at least 80%, at least 85%, at least 90%, at least 95%, or 100% identical to SEQ ID NO: 142. In some instances, effector protein comprises an amino acid sequence that is at least 70%, at least 75%, at least 80%, at least 85%, at least 90%, at least 95%, at least 99%, or 100% identical to SEQ ID NO: 42. In some instances, the amino acid sequence of the effector protein is at least 70%, at least 75%, at least 80%, at least 85%, at least 90%, at least 95%, at least 99%, or 100% identical to SEQ ID NO: 42. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 88; and a tracrRNA comprising a nucleobase sequence that is at least 70%, at least 75%, at least 80%, at least 85%, at least 90%, at least 95%, or 100% identical to SEQ ID NO: 143. In some instances, effector protein comprises an amino acid sequence that is at least 70%, at least 75%, at least 80%, at least 85%, at least 90%, at least 95%, at least 99%, or 100% identical to SEQ ID NO: 43. In some instances, the amino acid sequence of the effector protein is at least 70%, at least 75%, at least 80%, at least 85%, at least 90%, at least 95%, at least 99%, or 100% identical to SEQ ID NO: 43. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 88; and a tracrRNA comprising a nucleobase sequence that is at least 70%, at least 75%, at least 80%, at least 85%, at least 90%, at least 95%, or 100% identical to SEQ ID NO: 144. In some instances, effector protein comprises an amino acid sequence that is at least 70%, at least 75%, at least 80%, at least 85%, at least 90%, at least 95%, at least 99%, or 100% identical to SEQ ID NO: 43. In some instances, the amino acid sequence of the effector protein is at least 70%, at least 75%, at least 80%, at least 85%, at least 90%, at least 95%, at least 99%, or 100% identical to SEQ ID NO: 43. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 89; and a tracrRNA comprising a nucleobase sequence that is at least 70%, at least 75%, at least 80%, at least 85%, at least 90%, at least 95%, or 100% identical to SEQ ID NO: 145. In some instances, effector protein comprises an amino acid sequence that is at least 70%, at least 75%, at least 80%, at least 85%, at least 90%, at least 95%, at least 99%, or 100% identical to SEQ ID NO: 44. In some instances, the amino acid sequence of the effector protein is at least 70%, at least 75%, at least 80%, at least 85%, at least 90%, at least 95%, at least 99%, or 100% identical to SEQ ID NO: 44. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 89; and a tracrRNA comprising a nucleobase sequence that is at least 70%, at least 75%, at least 80%, at least 85%, at least 90%, at least 95%, or 100% identical to SEQ ID NO: 146. In some instances, effector protein comprises an amino acid sequence that is at least 70%, at least 75%, at least 80%, at least 85%, at least 90%, at least 95%, at least 99%, or 100% identical to SEQ ID NO: 44. In some instances, the amino acid sequence of the effector protein is at least 70%, at least 75%, at least 80%, at least 85%, at least 90%, at least 95%, at least 99%, or 100% identical to SEQ ID NO: 44. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 90; and a tracrRNA comprising a nucleobase sequence that is at least 70%, at least 75%, at least 80%, at least 85%, at least 90%, at least 95%, or 100% identical to SEQ ID NO: 147. In some instances, effector protein comprises an amino acid sequence that is at least 70%, at least 75%, at least 80%, at least 85%, at least 90%, at least 95%, at least 99%, or 100% identical to SEQ ID NO: 45. In some instances, the amino acid sequence of the effector protein is at least 70%, at least 75%, at least 80%, at least 85%, at least 90%, at least 95%, at least 99%, or 100% identical to SEQ ID NO: 45. In some instances, the crRNA and tracrRNA are linked as a sgRNA.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 35-45; a crRNA comprising a nucleobase sequence that is at least 70%, at least 75%, at least 80%, at least 85%, at least 90%, at least 95%, or 100% identical to SEQ ID NO: 90; and a tracrRNA comprising a nucleobase sequence that is at least 70%, at least 75%, at least 80%, at least 85%, at least 90%, at least 95%, or 100% identical to SEQ ID NO: 148. In some instances, effector protein comprises an amino acid sequence that is at least 70%, at least 75%, at least 80%, at least 85%, at least 90%, at least 95%, at least 99%, or 100% identical to SEQ ID NO: 45. In some instances, the amino acid sequence of the effector protein is at least 70%, at least 75%, at least 80%, at least 85%, at least 90%, at least 95%, at least 99%, or 100% identical to SEQ ID NO: 45. In some instances, the crRNA and tracrRNA are linked as a sgRNA.

A guide nucleic acid can comprise RNA, DNA, or a combination thereof. The term "gRNA" refers to a guide nucleic acid comprising RNA. A gRNA may include nucleosides that are not ribonucleic. In some embodiments, all nucleosides in a gRNA are ribonucleic. In some embodiments, some of the nucleosides in a gRNA are not ribonucleic. In embodiments where nucleosides in a gRNA are not ribonucleic, non-ribonucleic nucleosides may be naturally occurring or non-naturally-occurring nucleosides. In some embodiments, inter-nucleoside links are phosphodiester bonds. In some embodiments, the inter-nucleoside link between at least two nucleosides in a guide nucleic acid is not a phosphodiester bond. In some embodiments, the inter-nucleoside link between at least two nucleosides is a non-natural inter nucleoside linkage. Non-natural inter-nucleoside linkages include phosphorous and non-phosphorous inter-nucleoside linkages. Phosphorous inter-nucleoside linkages include phosphorothioate linkages and thiophosphate linkages. An inter-nucleoside linkage may comprise a "C3 spacer". C3 spacers are known to the skilled person as comprising a chain of three carbon atoms.

Guide nucleic acids may be modified to improve genome editing efficiency, increase stability, reduce off-target effects, and/or increase the affinity of the guide nucleic acid for an effector protein disclosed herein.

Modifications may include non-natural nucleotides and/or non-natural linkages. In addition or alternatively, one or more sugar moieties of the guide nucleic acid may be modified. Such sugar moiety modifications may include 2'-O-methyl (2'OMe), 2'-O-methyoxy-ethyl and 2' fluoro. In some embodiments, editing efficiency, or genome editing efficiency, is determined by analyzing the frequency of indel mutations in a nucleic acid or gene knockout. In some embodiments, the use of a flow cytometer or next generation sequencing may be used to analyze cells for indel mutations or gene knockout. In other embodiments, off-target effects may be detected using a flow cytometer, next generation sequencing, or CIRCLE-seq.

In some preferred embodiments, the first 3 nucleosides (or one of the first 3 nucleosides, or a combination of the first 3 nucleosides) from the 5' end of the repeat region comprise a 2'-O-methyl modification and the linkages between the 3 nucleosides at the 3' end of the spacer region comprise phosphorothioate linkages.

In some embodiments, the first nucleoside at the 5' end of the repeat region comprises a 2'-O-methyl modification. In some embodiments, the first two nucleosides at the 5' end of the repeat region comprise 2'-O-methyl modifications. In some embodiments, the first three nucleosides at the 5' end of the repeat region comprise 2'-O-methyl modifications. In some embodiments, the last nucleoside at the 3' end of the spacer region comprises a 2'-O-methyl modification. In some embodiments, the last two nucleosides at the 3' end of the spacer region comprise 2'-O-methyl modifications. In some embodiments, the last three nucleosides at the 3' end of the spacer region comprise 2'-O-methyl modifications.

In some embodiments, the first 3 nucleosides (or one of the first 3 nucleosides, or a combination of the first 3 nucleosides) from the 5' end of the repeat region and the 3 nucleosides at the 3' end of the spacer region comprise a 2'-O-methyl modification, and the linkages between the 3 nucleosides at the 3' end of the spacer region comprise phosphorothioate linkages.

In some embodiments, the first 3 nucleosides (or one of the first 3 nucleosides, or a combination of the first 3 nucleosides) from the 5' end of the repeat region and the 3 nucleosides at the 3' end of the spacer region comprise a 2'-fluoro modification.

In some embodiments, the first nucleoside at the 5' end of the repeat region comprises a 2' fluoro modification. In some embodiments, the first two nucleosides at the 5' end of the repeat region comprise 2' fluoro modifications. In some embodiments, the first three nucleosides at the 5' end of the repeat region comprise 2' fluoro modifications. In some embodiments, the last nucleoside at the 3' end of the spacer region comprises a 2' fluoro modification. In some embodiments, the last two nucleosides at the 3' end of the spacer region comprise 2' fluoro modifications. In some embodiments, the last three nucleosides at the 3' end of the spacer region comprise 2' fluoro modifications. In preferred embodiments, the last three nucleosides at the 3' end of the spacer region comprise 2' fluoro modifications.

In preferred embodiments, the first two nucleosides at the 5' end of the repeat region comprise 2'-O-methyl modifications, the first two nucleosides at the 5' end of the repeat are linked by a phosphorothioate linkage, and the last three nucleosides at the 3' end of the spacer region comprise 2' fluoro modifications.

In some embodiments, the linkage between the two nucleosides at the 5' end of the repeat region comprises a 3C spacer and the linkage between the two nucleosides at the 3' end of the spacer region comprises a 3C spacer.

In some embodiments, the guide nucleic acid comprises ribonucleic nucleosides and deoxyribonucleic nucleosides. In some embodiments, the guide nucleic acid is a guide RNA wherein the first, eighth and ninth nucleosides from the 5' end of the spacer region and the four nucleosides at the 3' end of the spacer region are deoxyribonucleic nucleosides.

In some embodiments, the guide nucleic acid comprises a polyA tail. In some preferred embodiments, the guide nucleic acid comprises a polyA tail at the 3' end of the spacer region.

In some embodiments, the engineered guide nucleic acid comprises at least 10, 11, 12, 13, 14, 15, 16, 17, 18, 19, 20, 21, 22, 23, 24, 25, 26, 27, 28, 29, or 30 contiguous nucleotides that are complementary to a eukaryotic sequence. Such a eukaryotic sequence is a sequence of nucleotides that is present in a host eukaryotic cell. Such a sequence of nucleotides is distinguished from nucleotide sequences present in other host cells, such as prokaryotic cells, or viruses. Said sequences present in a eukaryotic cell can be located a gene, an exon, an intron, a non-coding (e.g., promoter or enhancer) region, a selectable marker, tag, signal, and the like. In some cases, the engineered guide nucleic acid comprises at least 10 contiguous nucleotides that are complementary to a eukaryotic sequence. In some cases, the engineered guide nucleic acid comprises at least 11 contiguous nucleotides that are complementary to a eukaryotic sequence. In some cases, the engineered guide nucleic acid comprises at least 12 contiguous nucleotides that are complementary to a eukaryotic sequence. In some cases, the engineered guide nucleic acid comprises at least 13 contiguous nucleotides that are complementary to a eukaryotic sequence. In some cases, the engineered guide nucleic acid comprises at least 14 contiguous nucleotides that are complementary to a eukaryotic sequence. In some cases, the engineered guide nucleic acid comprises at least 15 contiguous nucleotides that are complementary to a eukaryotic sequence. In some cases, the engineered guide nucleic acid comprises at least 16 contiguous nucleotides that are complementary to a eukaryotic sequence. In some cases, the engineered guide nucleic acid comprises at least 17 contiguous nucleotides that are complementary to a eukaryotic sequence. In some cases, the engineered guide nucleic acid comprises at least 18 contiguous nucleotides that are complementary to a eukaryotic sequence. In some cases, the engineered guide nucleic acid comprises at least 19 contiguous nucleotides that are complementary to a eukaryotic sequence. In some cases, the engineered guide nucleic acid comprises at least 20 contiguous nucleotides that are complementary to a eukaryotic sequence. In some cases, the engineered guide nucleic acid comprises at least 21 contiguous nucleotides that are complementary to a eukaryotic sequence. In some cases, the engineered guide nucleic acid comprises at least 22 contiguous nucleotides that are complementary to a eukaryotic sequence. In some cases, the engineered guide nucleic acid comprises at least 23 contiguous nucleotides that are complementary to a eukaryotic sequence. In some cases, the engineered guide nucleic acid comprises at least 24 contiguous nucleotides that are complementary to a eukaryotic sequence. In some cases, the engineered guide nucleic acid comprises at least 25 contiguous nucleotides that are complementary to a eukaryotic sequence. In some cases, the engineered guide nucleic acid comprises at least 26 contiguous nucleotides that are complementary to a eukaryotic sequence. In some cases, the engineered guide nucleic acid comprises at least 27 contiguous nucleotides that are complementary to a eukaryotic sequence. In some cases, the engineered guide nucleic acid comprises at least 28 contiguous nucleotides that are complementary to a eukaryotic sequence. In some cases, the engineered guide nucleic acid comprises at least 29 contiguous nucleotides that are complementary to a eukaryotic sequence. In some cases, the engineered guide nucleic acid comprises at least 30 or more contiguous nucleotides that are complementary to a eukaryotic sequence.

Effector Protein-sgRNA Complexes

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 22. In some instances, the amino acid sequence of the effector protein is at least 70%, at least 75%, at least 80%, at least 85%, at least 90%, at least 95%, at least 99%, or 100% identical to SEQ ID NO: 22.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 23. In some instances, the amino acid sequence of the effector protein is at least 70%, at least 75%, at least 80%, at least 85%, at least 90%, at least 95%, at least 99%, or 100% identical to SEQ ID NO: 23.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 24. In some instances, the amino acid sequence of the effector protein is at least 70%, at least 75%, at least 80%, at least 85%, at least 90%, at least 95%, at least 99%, or 100% identical to SEQ ID NO: 24.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 151. In some instances, effector protein comprises an amino acid sequence that is at least 70%, at least 75%, at least 80%, at least 85%, at least 90%, at least 95%, at least 99%, or 100% identical to SEQ ID NO: 25. In some instances, the amino acid sequence of the effector protein is at least 70%, at least 75%, at least 80%, at least 85%, at least 90%, at least 95%, at least 99%, or 100% identical to SEQ ID NO: 25.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 26. In some instances, the amino acid sequence of the effector protein is at least 70%, at least 75%, at least 80%, at least 85%, at least 90%, at least 95%, at least 99%, or 100% identical to SEQ ID NO: 26.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 28. In some instances, the amino acid sequence of the effector protein is at least 70%, at least 75%, at least 80%, at least 85%, at least 90%, at least 95%, at least 99%, or 100% identical to SEQ ID NO: 28.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 29. In some instances, the amino acid sequence of the effector protein is at least 70%, at least 75%, at least 80%, at least 85%, at least 90%, at least 95%, at least 99%, or 100% identical to SEQ ID NO: 29.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 152. In some instances, effector protein comprises an amino acid sequence that is at least 70%, at least 75%, at least 80%, at least 85%, at least 90%, at least 95%, at least 99%, or 100% identical to SEQ ID NO: 30. In some instances, the amino acid sequence of the effector protein is at least 70%, at least 75%, at least 80%, at least 85%, at least 90%, at least 95%, at least 99%, or 100% identical to SEQ ID NO: 30.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 151. In some instances, effector protein comprises an amino acid sequence that is at least 70%, at least 75%, at least 80%, at least 85%, at least 90%, at least 95%, at least 99%, or 100% identical to SEQ ID NO: 31. In some instances, the amino acid sequence of the effector protein is at least 70%, at least 75%, at least 80%, at least 85%, at least 90%, at least 95%, at least 99%, or 100% identical to SEQ ID NO: 31.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 152. In some instances, effector protein comprises an amino acid sequence that is at least 70%, at least 75%, at least 80%, at least 85%, at least 90%, at least 95%, at least 99%, or 100% identical to SEQ ID NO: 32. In some instances, the amino acid sequence of the effector protein is at least 70%, at least 75%, at least 80%, at least 85%, at least 90%, at least 95%, at least 99%, or 100% identical to SEQ ID NO: 32.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 153. In some instances, effector protein comprises an amino acid sequence that is at least 70%, at least 75%, at least 80%, at least 85%, at least 90%, at least 95%, at least 99%, or 100% identical to SEQ ID NO: 33. In some instances, the amino acid sequence of the effector protein is at least 70%, at least 75%, at least 80%, at least 85%, at least 90%, at least 95%, at least 99%, or 100% identical to SEQ ID NO: 33.

TABLE 13 provides exemplary compositions comprising D2S effector proteins, cr/sgRNAs (crRNA or sgRNA), and tracrRNAs. Each row in TABLE 13 represents an exemplary composition. In some instances, the cr/sgRNA and/or tracrRNA comprises a nucleobase sequence of any one of the sequences as shown in TABLE 13. In some instances, the nucleobase sequence of the cr/sgRNAs is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 13. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to any one of the tracrRNA sequences present in TABLE 13. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731. In some embodiments, the compositions are used to generate a modification of a target nucleic acid. In some embodiments, the target nucleic acid comprises a PAM sequence selected from any one of the PAM sequences in TABLE 13.

TABLE 14 provides exemplary compositions comprising D2S effector proteins, cr/sgRNAs, and tracrRNAs. Each row in TABLE 14 represents an exemplary composition. In some instances, the cr/sgRNA and/or tracrRNA comprises a nucleobase sequence of any one of the sequences as shown in TABLE 14. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 14. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to any one of the tracrRNA sequences present in TABLE 14. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731. In some embodiments, the compositions are used to generate a modification of a target nucleic acid. In some embodiments, the target nucleic acid comprises a PAM sequence selected from any one of the PAM sequences in TABLE 14.

TABLE 15 provides exemplary compositions comprising D2S effector proteins, cr/sgRNAs, and tracrRNAs. Each row in TABLE 15 represents an exemplary composition. In some instances, the cr/sgRNA and/or the tracrRNA comprises a nucleobase sequence of any one of the sequences as shown in TABLE 15. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of SEQ ID NOs: 463, 464, and 466. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to SEQ ID NO: 465. In some instances, a D2S effector protein can comprise a sequence at least 75%, at least 80%, at least 85%, at least 90%, at least 95%, at least 98%, at least 99% or 100% identical to any one of SEQ ID NOs: 223, 224, or 214.

TABLE 16 provides exemplary compositions comprising D2S effector proteins, and cr/sgRNAs. Each row in TABLE 16 represents an exemplary composition. In some instances, the cr/sgRNA comprise a nucleobase sequence of any one of the sequences as shown in TABLE 16. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to SEQ ID NO: 180 or 467. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731. In some embodiments, the compositions are used to generate a modification of a target nucleic acid. In some embodiments, the target nucleic acid comprises a PAM sequence selected from SEQ ID NOs: 369 or 370.

TABLE 17 provides exemplary compositions comprising D2S effector proteins, and cr/sgRNAs. Each row in TABLE 17 represents an exemplary composition. In some instances, the cr/sgRNA comprise a nucleobase sequence of any one of the sequences as shown in TABLE 17. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of SEQ ID NOs: 468-481. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731. In some embodiments, the compositions are used to generate a modification of a target nucleic acid. In some embodiments, the target nucleic acid comprises a PAM sequence selected from SEQ ID NOs: 368-371.

TABLE 18 provides exemplary compositions comprising D2S effector proteins, and cr/sgRNAs. Each row in TABLE 18 represents an exemplary composition. In some instances, the cr/sgRNA comprise a nucleobase sequence of any one of the sequences as shown in TABLE 18. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 18. In some instances, a D2S effector protein can comprise a sequence at least 75%, at least 80%, at least 85%, at least 90%, at least 95%, at least 98%, at least 99% or 100% identical to SEQ ID NO: 23.

TABLE 19 provides exemplary compositions comprising D2S effector proteins, and cr/sgRNAs. Each row in TABLE 19 represents an exemplary composition. In some instances, the cr/sgRNA comprise a nucleobase sequence of any one of the sequences as shown in TABLE 19. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 19. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731.

TABLE 20 provides exemplary compositions comprising D2S effector proteins, cr/sgRNAs, and tracrRNAs. Each row in TABLE 20 represents an exemplary composition. In some instances, the cr/sgRNA and/or the tracrRNA comprise a nucleobase sequence of any one of the sequences as shown in TABLE 20. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 20. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to any one of the tracrRNA sequences present in TABLE 20. In some instances, a D2S effector protein can comprise a sequence at least 75%, at least 80%, at least 85%, at least 90%, at least 95%, at least 98%, at least 99% or 100% identical to any one of SEQ ID NOs: 1-45, 202-293, or 728-731. In some embodiments, the compositions are used to generate a modification of a target nucleic acid. In some embodiments, the target nucleic acid comprises a PAM sequence selected from SEQ ID NOs: 304, 312, 313, 315, 324 or 335.

TABLE 21 provides exemplary compositions comprising D2S effector proteins, and cr/sgRNAs. Each row in TABLE 21 represents an exemplary composition. In some instances, the cr/sgRNA comprise a nucleobase sequence of any one of the sequences as shown in TABLE 21. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of SEQ ID NOs:

612-615. In some instances, a D2S effector protein can comprise a sequence at least 75%, at least 80%, at least 85%, at least 90%, at least 95%, at least 98%, at least 99% or 100% identical to any one of SEQ ID NOs: 232, 233, 240, or 227. In some embodiments, the compositions are used to generate a modification of a target nucleic acid. In some embodiments, the target nucleic acid comprises a PAM sequence selected from SEQ ID NOs: 301, 318, 335, 343, 360, or 365.

TABLE 22 provides an exemplary composition comprising a D2S effector protein, and a cr/sgRNA. The row in TABLE 22 represents an exemplary composition. In some instances, the cr/sgRNA comprises a nucleobase sequence shown in TABLE 22. In some instances, the nucleobase sequence of the sgRNA is at least 65%, at least 70%, at least 75%, at least 80%, at least 85%, at least 90%, at least 95%, at least 97%, or at least 98%, at least 99%, or 100% identical to SEQ ID NO: 616. In some instances, a D2S effector protein can comprise a sequence at least 75%, at least 80%, at least 85%, at least 90%, at least 95%, at least 98%, at least 99% or 100% identical to SEQ ID NO: 228. In some embodiments, the compositions are used to generate a modification of a target nucleic acid. In some embodiments, the target nucleic acid comprises the PAM sequence of SEQ ID NO: 368.

TABLE 23 provides exemplary compositions comprising D2S effector proteins, cr/sgRNAs, and tracrRNAs. Each row in TABLE 23 represents an exemplary composition. In some instances, the cr/sgRNA and/or the tracrRNA comprise a nucleobase sequence of any one of the sequences as shown in TABLE 23. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to of SEQ ID NOs: 617, 620 or 621. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to any one of SEQ ID NOs: 618-619. In some instances, a D2S effector protein can comprise a sequence at least 75%, at least 80%, at least 85%, at least 90%, at least 95%, at least 98%, at least 99% or 100% identical to SEQ ID NO: 215. In some embodiments, the compositions are used to generate a modification of a target nucleic acid. In some embodiments, the target nucleic acid comprises the PAM sequence of SEQ ID NO: 343.

TABLE 24 provides exemplary compositions comprising D2S effector proteins, cr/sgRNAs, and tracrRNAs. Each row in TABLE 24 represents an exemplary composition. In some instances, the cr/sgRNA and/or the tracrRNA comprise a nucleobase sequence of any one of the sequences as shown in TABLE 24. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of SEQ ID NOs: 68 and 149. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to SEQ ID NO: 120. In some instances, a D2S effector protein can comprise a sequence at least 75%, at least 80%, at least 85%, at least 90%, at least 95%, at least 98%, at least 99% or 100% identical to SEQ ID NO: 23. In some embodiments, the compositions are used to generate a modification of a target nucleic acid. In some embodiments, the target nucleic acid comprises a PAM sequence selected from SEQ ID NOs: 325-328.

TABLE 25 provides exemplary compositions comprising D2S effector proteins, sgRNAs, linker sequences, repeat sequences, spacer sequences, and tracrRNAs. Each row in TABLE 25 represents an exemplary composition. In some instances, the cr/sgRNA and/or the tracrRNA comprise a nucleobase sequence of any one of the sequences as shown in TABLE 25. In some instances, the linker sequence, the repeat sequence, and/or the spacer sequence comprise a nucleobase sequence of any one of the sequences as shown in TABLE 25. In some instances, the nucleobase sequence of the cr/sgRNA is at least 65%, at least 70%, at least 75%, at least 80%, at least 85%, at least 90%, at least 95%, at least 97%, or at least 98%, at least 99%, or 100% identical to any one of the cr/sgRNA sequences present in TABLE 25. In some instances, the nucleobase sequence of the tracrRNA is at least 65%, at least 70%, at least 75%, at least 80%, at least 85%, at least 90%, at least 95%, at least 97%, or at least 98%, at least 99%, or 100% identical to any one of the tracrRNA sequences present in TABLE 25. In some instances, the nucleobase sequence of the linker sequence is at least 65%, at least 70%, at least 75%, at least 80%, at least 85%, at least 90%, at least 95%, at least 97%, or at least 98%, at least 99%, or 100% identical to SEQ ID NO: 623. In some instances, the nucleobase sequence of the repeat sequence is at least 65%, at least 70%, at least 75%, at least 80%, at least 85%, at least 90%, at least 95%, at least 97%, or at least 98%, at least 99%, or 100% identical to any one of the repeat sequences present in TABLE 25. In some instances, the nucleobase sequence of the spacer sequence is at least 65%, at least 70%, at least 75%, at least 80%, at least 85%, at least 90%, at least 95%, at least 97%, or at least 98%, at least 99%, or 100% identical to any one of the spacer sequences present in TABLE 25. In some instances, a D2S effector protein can comprise a sequence at least 75%, at least 80%, at least 85%, at least 90%, at least 95%, at least 98%, at least 99% or 100% identical to SEQ ID NO: 23.

TABLE 26 provides exemplary spacer sequences. In some instances, the spacer sequence comprises a nucleobase sequence shown in TABLE 26. In some instances, the nucleobase sequence of the spacer sequence is at least 65%, at least 70%, at least 75%, at least 80%, at least 85%, at least 90%, at least 95%, at least 97%, or at least 98%, at least 99%, or 100% identical to the spacer sequence present in TABLE 26.

TABLE 28 provides exemplary spacer sequences. In some instances, the spacer sequence comprises a nucleobase sequence shown in TABLE 28. In some instances, the nucleobase sequence of the spacer sequence is at least 65%, at least 70%, at least 75%, at least 80%, at least 85%, at least 90%, at least 95%, at least 97%, or at least 98%, at least 99%, or 100% identical to the spacer sequence present in TABLE 28.

TABLE 34 provides exemplary compositions comprising D2S effector proteins and sgRNAs with and without spacer sequences. Each row in TABLE 34 represents an exemplary composition. In some instances, the nucleobase sequence of a guide RNA is at least 65%, at least 70%, at least 75%, at least 80%, at least 85%, at least 90%, at least 95%, at least 97%, or at least 98%, at least 99%, or 100% identical to any one of the guide RNA (with or without a spacer) sequences present in TABLE 34.

Effector Protein-sgRNA Complexes

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 22. In some instances, the amino acid sequence of the effector protein is at least 70%, at least 75%, at least 80%, at least 85%, at least 90%, at least 95%, at least 99%, or 100% identical to SEQ ID NO: 22.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 23. In some instances, the amino acid sequence of the effector protein is at least 70%, at least 75%, at least 80%, at least 85%, at least 90%, at least 95%, at least 99%, or 100% identical to SEQ ID NO: 23.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 24. In some instances, the amino acid sequence of the effector protein is at least 70%, at least 75%, at least 80%, at least 85%, at least 90%, at least 95%, at least 99%, or 100% identical to SEQ ID NO: 24.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 151. In some instances, effector protein comprises an amino acid sequence that is at least 70%, at least 75%, at least 80%, at least 85%, at least 90%, at least 95%, at least 99%, or 100% identical to SEQ ID NO: 25. In some instances, the amino acid sequence of the effector protein is at least 70%, at least 75%, at least 80%, at least 85%, at least 90%, at least 95%, at least 99%, or 100% identical to SEQ ID NO: 25.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 149. In some instances, effector protein comprises an amino acid sequence that is at least 70%, at least 75%, at least 80%, at least 85%, at least 90%, at least 95%, at least 99%, or 100% identical to SEQ ID NO: 26. In some instances, the amino acid sequence of the effector protein is at least 70%, at least 75%, at least 80%, at least 85%, at least 90%, at least 95%, at least 99%, or 100% identical to SEQ ID NO: 26.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 28. In some instances, the amino acid sequence of the effector protein is at least 70%, at least 75%, at least 80%, at least 85%, at least 90%, at least 95%, at least 99%, or 100% identical to SEQ ID NO: 28.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 150. In some instances, effector protein comprises an amino acid sequence that is at least 70%, at least 75%, at least 80%, at least 85%, at least 90%, at least 95%, at least 99%, or 100% identical to SEQ ID NO: 29. In some instances, the amino acid sequence of the effector protein is at least 70%, at least 75%, at least 80%, at least 85%, at least 90%, at least 95%, at least 99%, or 100% identical to SEQ ID NO: 29.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 152. In some instances, effector protein comprises an amino acid sequence that is at least 70%, at least 75%, at least 80%, at least 85%, at least 90%, at least 95%, at least 99%, or 100% identical to SEQ ID NO: 30. In some instances, the amino acid sequence of the effector protein is at least 70%, at least 75%, at least 80%, at least 85%, at least 90%, at least 95%, at least 99%, or 100% identical to SEQ ID NO: 30.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 151. In some instances, effector protein comprises an amino acid sequence that is at least 70%, at least 75%, at least 80%, at least 85%, at least 90%, at least 95%, at least 99%, or 100% identical to SEQ ID NO: 31. In some instances, the amino acid sequence of the effector protein is at least 70%, at least 75%, at least 80%, at least 85%, at least 90%, at least 95%, at least 99%, or 100% identical to SEQ ID NO: 31.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 152. In some instances, effector protein comprises an amino acid sequence that is at least 70%, at least 75%, at least 80%, at least 85%, at least 90%, at least 95%, at least 99%, or 100% identical to SEQ ID NO: 32. In some instances, the amino acid sequence of the effector protein is at least 70%, at least 75%, at least 80%, at least 85%, at least 90%, at least 95%, at least 99%, or 100% identical to SEQ ID NO: 32.

In some instances, compositions disclosed herein comprises an effector protein comprising an amino acid sequence that is at least 70%, at least 75%, at least 80%, at least 85%, at least 90%, at least 95%, at least 99%, or 100% identical to any one of SEQ ID NOs: 22-34; and a guide RNA comprising a nucleobase sequence that is at least 70%, at least 75%, at least 80%, at least 85%, at least 90%, at least 95%, at least 97%, at least 99%, or 100% identical to SEQ ID NO: 153. In some instances, effector protein comprises an amino acid sequence that is at least 70%, at least 75%, at least 80%, at least 85%, at least 90%, at least 95%, at least 99%, or 100% identical to SEQ ID NO: 33. In some instances, the amino acid sequence of the effector protein is at least 70%, at least 75%, at least 80%, at least 85%, at least 90%, at least 95%, at least 99%, or 100% identical to SEQ ID NO: 33.

Pooling Guide Nucleic Acids

In some instances, compositions, systems or methods provided herein comprise a pool of guide nucleic acids. In some instances, the pool of guide nucleic acids were tiled against a target nucleic acid, e.g., the genomic locus of interest or uses thereof. In some instances, a guide nucleic acid is selected from a group of guide nucleic acids that have been tiled against a nucleic acid sequence of a genomic locus of interest. The genomic locus of interest may belong to a viral genome, a bacterial genome, or a mammalian genome. Non-limiting examples of viral genomes are an HPV genome, an HIV genome, an influenza genome, or a coronavirus genome. Often, these guide nucleic acids are pooled for detecting a target nucleic acid in a single assay. Pooling of guide nucleic acids may ensure broad spectrum identification, or broad coverage, of a target species within a single reaction. This may be particularly helpful in diseases or indications, like sepsis, that may be caused by multiple organisms. The pool of guide nucleic acids may enhance the detection of a target nucleic using systems of methods described herein relative to detection with a single guide nucleic acid. The pool of guide nucleic acids may ensure broad coverage of the target nucleic acid within a single reaction using the methods described herein. In some instances, the pool of guide nucleic acids are collectively complementary to at least 50%, at least 55%, at least 60%, at least 65%, at least 70%, at least 75%, at least 80%, at least 85%, at least 90%, at least 95% or 100% of the target nucleic acid. In some instances, at least a portion of the guide nucleic acids of the pool overlap in sequence. In some instances, at least a portion of the guide nucleic acids of the pool do not overlap in sequence. In some cases, the pool of guide nucleic acids comprises at least 2, at least 3, at least 4, at least 5, or at least 6 guide nucleic acids targeting different sequences of a target nucleic acid.

Intermediary Nucleic Acids

A guide nucleic acid may comprise or be coupled to an intermediary nucleic acid. The intermediary nucleic acid may also be referred to as an intermediary RNA, although it may comprise deoxyribonucleosides in addition to ribonucleosides. The intermediary RNA may be separate from, but forms a complex with a crRNA to form a discrete gRNA system. The intermediary RNA may be linked to a crRNA to form a composite gRNA. A D2S effector protein may bind a crRNA and an intermediary RNA. In some cases, the crRNA and the intermediary RNA are provided as a single nucleic acid (e.g., covalently linked). In some instances, the crRNA and the intermediary RNA are separate polynucleotides (e.g., a discrete gRNA system). An intermediary RNA may comprise a repeat hybridization region and a hairpin region. The repeat hybridization region may hybridize to all or part of the sequence of the repeat of a crRNA. The repeat hybridization region may be positioned 3' of the hairpin region. The hairpin region may comprise a first sequence, a second sequence that is reverse complementary to the first sequence, and a stem-loop linking the first sequence and the second sequence.

The D2S effector protein (RNP) complex may comprise a D2S effector protein complexed with a guide nucleic acid (e.g., a crRNA) and an intermediary RNA. Sometimes, a guide nucleic acid comprises a crRNA and an intermediary RNA (e.g., the crRNA and intermediary RNA are provided as a single nucleic acid molecule). A composition may comprise a crRNA, an intermediary RNA, a D2S effector protein, and a detector nucleic acid.

In some instances, the length of intermediary RNAs is not greater than 50, 56, 68, 71, 73, 95, or 105 linked nucleosides. In some instances, the length of an intermediary RNA is about 30 to about 120 linked nucleosides. In some instances, the length of an intermediary RNA is about 50 to about 105, about 50 to about 95, about 50 to about 73, about 50 to about 71, about 50 to about 68, or about 50 to about 56 linked nucleosides. In some instances, the length of an intermediary RNA is 56 to 105 linked nucleosides, from 56 to 105 linked nucleosides, 68 to 105 linked nucleosides, 71 to 105 linked nucleosides, 73 to 105 linked nucleosides, or 95 to 105 linked nucleosides. In some instances, the length of an intermediary RNA is 40 to 60 nucleotides. In some instances, the length of the intermediary RNA is 50, 56, 68, 71, 73, 95, or 105 linked nucleosides. In some instances, the length of the intermediary RNA is 50 nucleotides.

An exemplary intermediary RNA may comprise, from 5' to 3', a 5' region, a hairpin region, a repeat hybridization region, and a 3' region. In some cases, the 5' region may hybridize to the 3' region. In some instances, the 5' region does not hybridize to the 3' region. In some cases, the 3' region is covalently linked to the crRNA (e.g., through a phosphodiester bond). In some instances, an intermediary RNA may comprise an un-hybridized region at the 3' end of the intermediary RNA. The un-hybridized region may have a length of about 1, about 2, about 3, about 4, about 5, about 6, about 7, about 8, about 9, about 10, about 12, about 14, about 16, about 18, or about 20 linked nucleosides. In some instances, the length of the un-hybridized region is 0 to 20 linked nucleosides.

VII. Vectors and Multiplexed Expression Vectors

In some instances, compositions and systems provided herein comprise a vector system encoding a polypeptide (e.g., an effector protein) described herein. In some instances, compositions and systems provided herein comprise a vector system encoding a guide nucleic acid (e.g., crRNA, tracrRNA, or sgRNA) described herein. In some instances, compositions and systems provided herein comprise a multi-vector system encoding an effector protein and a guide nucleic acid described herein, wherein the guide nucleic acid and the effector protein are encoded by the same or different vectors. In some instances, the engineered guide and the engineered effector protein are encoded by different vectors of the system. In some embodiments, a nucleic acid encoding a polypeptide (e.g., an effector protein) comprises an expression vector. In some embodiments, a nucleic acid encoding a polypeptide is a messenger RNA. In some embodiments, an expression vector comprises or encodes an engineered guide nucleic acid. In some cases, the expression vector encodes the crRNA or sgRNA.

In some instances, a vector may encode one or more engineered effector proteins. In some instances, a vector may encode 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, or 45 engineered effector proteins. In some instances, a vector can encode one or more engineered effector proteins comprising an amino acid sequence of any one of SEQ ID NOs: 1-45. In some instances, a vector can encode one or more engineered effector proteins comprising an amino acid sequence of any one of SEQ ID NOs: 1-45, 202-293, or 728-731. In some instances, a vector can encode one or more engineered effector proteins comprising an amino acid sequence with at least 75%, 80%, 85%, 90%, 95% or 98% sequence identity to any one of SEQ ID NOs: 1-45. In some instances, a vector can encode one or more engineered effector proteins comprising an amino acid sequence with at least 75%, 80%, 85%, 90%, 95% or 98% sequence identity to any one of SEQ ID NOs: 1-45, 202-293, or 728-731.

In some instances, a vector may encode one or more guide nucleic acids. In some instances, a vector may encode 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, or 45 different guide nucleic acids. In some instances, a vector can encode one or more guide nucleic acids comprising a crRNA sequence of any one of SEQ ID NOs: 46-90. In some instances, a vector can encode one or more guide nucleic acids comprising a crRNA sequence with at least 75%, 80%, 85%, 90%, 95% or 98% sequence identity to any one of SEQ ID NOs: 46-90. In some instances, a vector can encode one or more guide nucleic acids comprising a crRNA sequence of any one of SEQ ID NOs: 91-148. In some instances, a vector can encode one or more guide nucleic acids comprising a tracrRNA sequence with at least 75%, 80%, 85%, 90%, 95% or 98% sequence identity to any one of SEQ ID NOs: 91-148. In some instances, the tracrRNA and the crRNA may be linked into a single guide RNA. In some instances, a vector can encode one or more guide nucleic acids comprising a nucleobase any one of SEQ ID NOs: 149-153. In some instances, a vector can encode one or more guide nucleic acids comprising a guide sequence with at least 75%, 80%, 85%, 90%, 95% or 98% sequence identity to any one of SEQ ID NOs: 149-153.

Lipid Particles

In some instances, compositions and systems provided herein comprise a lipid particle. In some embodiments, a lipid particle is a lipid nanoparticle (LNP). In some embodiments, a lipid or a lipid nanoparticle can encapsulate an expression vector. In some embodiments, a lipid or a lipid nanoparticle can encapsulate the D2S effector protein, the sgRNA or crRNA, the nucleic acid encoding the D2S effector protein and/or the DNA molecule encoding the sgRNA or crRNA. LNPs are a non-viral delivery system for gene therapy. LNPs are effective for delivery of nucleic acids. Beneficial properties of LNP include ease of manufacture, low cytotoxicity and immunogenicity, high efficiency of nucleic acid encapsulation and cell transfection, multi-dosing capabilities and flexibility of design (Kulkarni et al., (2018) Nucleic Acid Therapeutics, 28(3):146-157). In some cases, a method can comprise contacting a cell with an expression vector. In some cases, contacting can comprise electroporation, lipofection, or lipid nanoparticle (LNP) delivery of an expression vector.

Viral Vectors

An expression vector can be a viral vector. In some embodiments, a viral vector comprises a nucleic acid to be delivered into a host cell via a recombinantly produced virus or viral particle. The nucleic acid may be single-stranded or double stranded, linear or circular, segmented or non-segmented. The nucleic acid may comprise DNA, RNA, or a combination thereof. In some embodiments, the expression vector is an adeno-associated viral vector. There are a variety of viral vectors that are associated with various types of viruses, including but not limited to retroviruses (e.g., lentiviruses and γ-retroviruses), adenoviruses, arenaviruses, alphaviruses, adeno-associated viruses (AAVs), baculoviruses, vaccinia viruses, herpes simplex viruses and poxviruses. A viral vector provided herein can be derived from or based on any such virus. Often the viral vectors provided herein are an adeno-associated viral vector (AAV vector). Generally, an AAV vector has two inverted terminal repeats (ITRs). According, in some embodiments, the viral vector provided herein comprises two inverted terminal repeats of AAV. The DNA sequence in between the ITRs of an AAV vector provided herein may be referred to herein as the sequence encoding the genome editing tools. These genome editing tools can include, but are not limited to, an effector protein, effector protein modifications (e.g., nuclear localization signal (NLS), polyA tail), guide nucleic acid(s), respective promoter(s), and a donor nucleic acid, or combinations thereof. In some embodiments, a nuclear localization signal comprises an entity (e.g., peptide) that facilitates localization of a nucleic acid, protein, or small molecule to the nucleus, when present in a cell that contains a nuclear compartment.

In general, viral vectors provided herein comprise at least one promotor or a combination of promoters driving expression or transcription of one or more genome editing tools described herein. In some embodiments, the length of the promoter is less than about 500, less than about 400, or less than about 300 linked nucleotides. In some embodiments, the length of the promoter is at least 100 linked nucleotides. Non-limiting examples of promoters include CMV, EF1a, RPBSA, hPGK, EFS, SV40, PGK1, Ubc, human beta actin promoter, CAG, TRE, UAS, Ac5, Polyhedrin, CaMKIIa, GAL1, H1, TEF1, GDS, ADH1, CaMV35S, Ubi, U6, MNDU3, and MSCV. In some embodiments, the promoter is an inducible promoter that only drives expression of its corresponding gene when a signal is present, e.g., a hormone, a small molecule, a peptide. Non-limiting examples of inducible promoters are the T7 RNA polymerase promoter, the T3 RNA polymerase promoter, the Isopropyl-beta-D-thiogalactopyranoside (IPTG)-regulated promoter, a lactose induced promoter, a heat shock promoter, a tetracycline-regulated promoter (tetracycline-inducible or tetracycline-repressible), a steroid regulated promoter, a metal-regulated promoter, and an estrogen receptor-regulated promoter. In some embodiments, the promoter is an activation-inducible promoter, such as a CD69 promoter, as described further in Kulemzin et al., (2019), *BMC Med Genomics*, 12:44.

In some embodiments, the coding region of the AAV vector forms an intramolecular double-stranded DNA template thereby generating an AAV vector that is a self-complementary AAV (scAAV) vector. In general, the sequence encoding the genome editing tools of an scAAV vector has a length of about 2 kb to about 3 kb. The scAAV vector can comprise nucleotide sequences encoding an effector protein, providing guide nucleic acids described herein, and a donor nucleic acid described herein. In some embodiments, the AAV vector provided herein is a self-inactivating AAV vector.

In some embodiments, an AAV vector provided herein comprises a modification, such as an insertion, deletion, chemical alteration, or synthetic modification, relative to a wild-type AAV vector.

In some embodiments, the viral particle that delivers the viral vector described herein is an AAV. AAVs are characterized by their serotype. Non-limiting examples of AAV serotypes are AAV1, AAV2, AAV3, AAV4, AAV5, AAV6, AAV7, AAV8, AAV9, AAV10, AAV11, AAV12, scAAV, AAV-rh10, chimeric or hybrid AAV, or any combination, derivative, or variant thereof Producing AAV Particles The AAV particles described herein can be referred to as recombinant AAV (rAAV). Often, rAAV particles are generated by transfecting AAV producing cells with an AAV-containing plasmid carrying the sequence encoding the genome editing tools, a plasmid that carries viral encoding regions, i.e., Rep and Cap gene regions; and a plasmid that provides the helper genes such as E1A, E1B, E2A, E4ORF6 and VA. In some embodiments, the AAV producing cells are mammalian cells. In some embodiments, host cells for rAAV viral particle production are mammalian cells. In some embodiments, a mammalian cell for rAAV viral particle production is a COS cell, a HEK293T cell, a HeLa cell, a KB cell, a derivative thereof, or a combination thereof. In some embodiments, rAAV virus particles can be produced in the mammalian cell culture system by providing the rAAV plasmid to the mammalian cell. In some embodiments, producing rAAV virus particles in a mammalian cell can comprise transfecting vectors that express the rep protein, the capsid protein, and the gene-of-interest expression construct flanked by the ITR sequence on the 5' and 3' ends. Methods of such processes are provided in, for example, Naso et al., BioDrugs, 2017 August; 31(4):317-334 and Benskey et al., (2019), Methods Mol Biol., 1937:3-26, each of which is incorporated by reference in their entireties.

In some embodiments, rAAV is produced in a non-mammalian cell. In some embodiments, rAAV is produced in an insect cell. In some embodiments, an insect cell for producing rAAV viral particles comprises a Sf9 cell. In some embodiments, production of rAAV virus particles in insect cells can comprise baculovirus. In some embodiments, production of rAAV virus particles in insect cells can comprise infecting the insect cells with three recombinant baculoviruses, one carrying the cap gene, one carrying the rep gene, and one carrying the gene-of-interest expression construct enclosed by an ITR on both the 5' and 3' end. In some embodiments, rAAV virus particles are produced by the One Bac system. In some embodiments, rAAV virus particles can be produced by the Two Bac system. In some embodiments, in the Two Bac system, the rep gene and the cap gene of the AAV is integrated into one baculovirus virus genome, and the ITR sequence and the gene-of-interest expression construct is integrated into another baculovirus virus genome. In some embodiments, in the One Bac system, an insect cell line that expresses both the rep protein and the capsid protein is established and infected with a baculovirus virus integrated with the ITR sequence and the gene-of-interest expression construct. Details of such processes are provided in, for example, Smith et. al., (1983), *Mol. Cell. Biol.*, 3(12):2156-65; Urabe et al., (2002), *Hum. Gene. Ther.*, 1; 13(16):1935-43; and Benskey et al., (2019), *Methods Mol Biol.*, 1937:3-26, each of which is incorporated by reference in its entirety.

VIII. Modifications

Polypeptides (e.g., effector proteins) and nucleic acids (e.g., engineered guide nucleic acids) described herein can be further modified as described throughout and as further described herein.

Examples are modifications of interest that do not alter primary sequence, including chemical derivatization of polypeptides, e.g., acylation, acetylation, carboxylation, amidation, etc. Also included are modifications of glycosylation, e.g. those made by modifying the glycosylation patterns of a polypeptide during its synthesis and processing or in further processing steps; e.g. by exposing the polypeptide to enzymes which affect glycosylation, such as mammalian glycosylating or deglycosylating enzymes. Also embraced are sequences that have phosphorylated amino acid residues, e.g. phosphotyrosine, phosphoserine, or phosphothreonine.

Modifications disclosed herein can also include modification of described polypeptides and/or engineered guide nucleic acids through any suitable method, such as molecular biological techniques and/or synthetic chemistry, to improve their resistance to proteolytic degradation, to change the target sequence specificity, to optimize solubility properties, to alter protein activity (e.g., transcription modulatory activity, enzymatic activity, etc.) or to render them more suitable. Analogs of such polypeptides include those containing residues other than naturally occurring L-amino acids, e.g. D-amino acids or non-naturally occurring synthetic amino acids. D-amino acids may be substituted for some or all of the amino acid residues. Modifications can also include modifications with non-naturally occurring unnatural amino acids. The particular sequence and the manner of preparation will be determined by convenience, economics, purity required, and the like.

Modifications can further include the introduction of various groups to polypeptides and/or engineered guide nucleic acids described herein. For example, groups can be introduced during synthesis or during expression of a polypeptide (e.g., a effector protein), which allow for linking to other molecules or to a surface. Thus, e.g., cysteines can be used to make thioethers, histidines for linking to a metal ion complex, carboxyl groups for forming amides or esters, amino groups for forming amides, and the like.

Modifications can further include modification of nucleic acids described herein (e.g., engineered guide nucleic acids) to provide the nucleic acid with a new or enhanced feature, such as improved stability. Such modifications of a nucleic acid include a base modification, a backbone modification, a sugar modification, or combinations thereof, of one or more nucleotides, nucleosides, or nucleobases in a nucleic acid.

In some embodiments, nucleic acids (e.g., engineered guide nucleic acids) described herein comprise one or more modifications comprising: 2'O-methyl modified nucleotides, 2' Fluoro modified nucleotides; locked nucleic acid (LNA) modified nucleotides; peptide nucleic acid (PNA) modified nucleotides; nucleotides with phosphorothioate linkages; a 5' cap (e.g., a 7-methylguanylate cap (m7G)), phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkyl phosphoramidates, phosphorodiamidates, thionophosphor amidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage; phosphorothioate and/or heteroatom internucleoside linkages, such as —CH2-NH—O—CH2-, —CH2-N (CH3)-O—CH2- (known as a methylene (methylimino) or MMI backbone), —CH2-O—N(CH3)-CH2-, —CH2-N (CH3)-N(CH3)-CH2- and —O—N(CH3)-CH2-CH2- (wherein the native phosphodiester internucleotide linkage is represented as —O—P(=O)(OH)—O—CH2-); morpholino linkages (formed in part from the sugar portion of a nucleoside); morpholino backbones; phosphorodiamidate or other non-phosphodiester internucleoside linkages; siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; other backbone modifications having mixed N, O, S and CH2 component parts; and combinations thereof.

IX. Systems

Disclosed herein, in some aspects, are systems for modifying a nucleic acid, comprising any one of the D2S effector proteins described herein, or a multimeric complex thereof. Systems may have components that can be used to detect, modify, or edit a target nucleic acid, wherein such components include, separately or in combination as a composition, a D2S effector protein, a guide nucleic acid, or other reagent or molecule described herein. Systems may be used to modify the activity or expression of a target nucleic acid. In some instances, systems comprise a D2S effector protein described herein, a reagent, support medium, or a combination thereof. In some instances, the D2S effector protein comprises a D2S effector protein, or a fusion protein thereof, described herein. In some instances, the D2S effector protein comprises an amino acid sequence that is at least 70%, at least 75%, at least 80%, at least 85%, at least 90%, at least 95%, or 100% identical to any one of SEQ ID NOs: 1-45. In some instances, the D2S effector protein comprises an amino acid sequence that is at least 70%, at least 75%, at least 80%, at least 85%, at least 90%, at least 95%, or 100% identical to any one of SEQ ID NOs: 1-45, 202-293, or 728-731. In some instances, the amino acid sequence of the D2S effector protein is at least 70%, at least 75%, at least 80%, at least 85%, at least 90%, at least 95%, or 100% identical to any one of SEQ ID NOs: 1-45. In some instances, the amino acid sequence of the D2S effector protein is at least 70%, at least 75%, at least 80%, at least 85%, at least 90%, at least 95%, or 100% identical to any one of SEQ ID NOs: 1-45, 202-293, or 728-731. Such systems may be used for detecting the presence of a target nucleic acid associated with or causative of a disease, such as cancer, a genetic disorder, or an infection. In some instances, such methods and systems are useful for phenotyping, genotyping, or determining ancestry. Unless specified otherwise, systems include kits and may be referred to as kits. Unless specified otherwise, systems include devices and may also be referred to as devices. Systems described herein may be provided in the form of a companion diagnostic assay or device, a point-of-care assay or device, or an over-the-counter diagnostic assay/device.

Systems described herein, in some aspects, are for detecting or modifying a target sequence of a target nucleic acid comprising: a) a polypeptide (e.g., an effector protein) described herein, or a nucleic acid encoding the polypeptide; and b) an engineered guide nucleic acid. In some cases, the polypeptide comprises an amino acid sequence that is at least 85%, at least 90%, at least 95%, or at least 100% identical to SEQ ID NO: 23. In some cases, the engineered guide nucleic acid comprises a sequence that is at least 60%, at least 65%, at least 70%, at least 75%, at least 80%, at least 85%, at least 90%, at least 95%, or at least 100% identical to 624, 628, 630, 634, 638, 641, 643, and 645. In some cases, the target nucleic acid comprises a protospacer adjacent motif (PAM) selected from SEQ ID NOS: 156-159, 325-328, or 343. In some embodiments, the PAM is required for the polypeptide and engineered guide nucleic acid to detect or modify the target sequence. In some cases, the polypeptide comprises a mutation that reduces a catalytic activity of the polypeptide relative to the polypeptide that is 100% identical to SEQ ID NO: 23. In some cases, the polypeptide is capable of binding to the target nucleic acid but has reduced or no nuclease activity on the target nucleic acid. In some cases, the polypeptide is a nuclease that is capable of cleaving at least one strand of a target nucleic acid. In some cases, the system comprises a fusion partner protein fused to the polypeptide. In some cases, the system comprises at least one of a detection reagent and an amplification reagent. In some cases, the detection reagent is selected from: a reporter nucleic acid, a detection moiety, an additional polypeptide, and a combination thereof. In some cases, the at least one amplification reagent is selected from: the group consisting of a primer, a polymerase, a dNTP, an rNTP, and combinations thereof. In some cases, the target nucleic acid comprises a protospacer adjacent motif (PAM) selected from any one of SEQ ID NOS: 156-159, 325-328, and 369, and the PAM is required for the polypeptide and engineered guide nucleic acid to detect or modify the target sequence. In some cases, the target nucleic acid comprises a PAM sequence of SEQ ID NO: 369. Also described herein are compositions comprising a polypeptide and an engineered guide nucleic acid. In some embodiments, the polypeptide comprises an amino acid sequence that is at least at least 80%, at least 85%, at least 90%, at least 95%, or at least 100% identical to SEQ ID NO: 23. In some embodiments, the engineered guide nucleic acid comprises a sequence that is at least 70%, at least 75%, at least 80%, at least 85%, at least 90%, at least 95%, or at least 100% identical to a sequence selected from: SEQ ID NOS: 624, 628, 630, 634, 638, 641, 643, and 645. In some embodiments, the polypeptide is fused to at least one nuclear localization signal. In some cases, the polypeptide is capable of binding to the target nucleic acid but has reduced or no nuclease activity on the target nucleic acid. In some cases, the polypeptide is a nuclease that is capable of cleaving at least one strand of a target nucleic acid. In some cases, the system comprises a fusion partner protein fused to the polypeptide. In some cases, the length of the polypeptide is about 450 to about 550, about 400 to about 600, or about 450 to about 500 linked amino acids. In some cases, the composition comprises a recombinase. In some cases, the composition further comprises a target nucleic acid, and wherein the target nucleic acid comprises a PAM sequence selected from any one of SEQ ID NOs: 156-159, 325-328, and 369. In some cases, the composition comprises a donor nucleic acid.

Reagents and effector proteins of various systems may be provided in a reagent chamber or on the support medium. Alternatively, the reagent and/or effector protein may be contacted with the reagent chamber or the support medium by the individual using the system. An exemplary reagent chamber is a test well or container. The opening of the reagent chamber may be large enough to accommodate the support medium. Optionally, the system comprises a buffer and a dropper. The buffer may be provided in a dropper bottle for ease of dispensing. The dropper may be disposable and transfer a fixed volume. The dropper may be used to place a sample into the reagent chamber or on the support medium.

System Solutions

In general, systems comprise a solution in which the activity of an effector protein occurs. Often, the solution comprises or consists essentially of a buffer. The solution or buffer may comprise a buffering agent, a salt, a crowding agent, a detergent, a reducing agent, a competitor, or a combination thereof. Often the buffer is the primary component or the basis for the solution in which the activity occurs. Thus, concentrations for components of buffers described herein (e.g., buffering agents, salts, crowding agents, detergents, reducing agents, and competitors) are the same or essentially the same as the concentration of these components in the solution in which the activity occurs. In some instances, a buffer is required for cell lysis activity or viral lysis activity.

In some instances, systems comprise a buffer, wherein the buffer comprise at least one buffering agent. Exemplary buffering agents include HEPES, TRIS, MES, ADA, PIPES, ACES, MOPSO, BIS-TRIS propane, BES, MOPS, TES, DISO, Trizma, TRICINE, GLY-GLY, HEPPS, BICINE, TAPS, A MPD, A MPSO, CHES, CAPSO, AMP, CAPS, phosphate, citrate, acetate, imidazole, or any combination thereof. In some instances, the concentration of the buffering agent in the buffer is 1 mM to 200 mM. A buffer compatible with an effector protein may comprise a buffering agent at a concentration of 10 mM to 30 mM. A buffer compatible with an effector protein may comprise a buffering agent at a concentration of about 20 mM. A buffering agent may provide a pH for the buffer or the solution in which the activity of the effector protein occurs. The pH may be 3 to 4, 3.5 to 4.5, 4 to 5, 4.5 to 5.5, 5 to 6, 5.5 to 6.5, 6 to 7, 6.5 to 7.5, 7 to 8, 7.5 to 8.5, 8 to 9, 8.5 to 9.5, 9 to 10, or 9.5 to 10.5.

In some instances, systems comprise a solution, wherein the solution comprises at least one salt. In some instances, the at least one salt is selected from potassium acetate, magnesium acetate, sodium chloride, potassium chloride, magnesium chloride, calcium chloride, and any combination thereof. In some instances, the concentration of the at least one salt in the solution is 5 mM to 100 mM, 5 mM to 10 mM, 1 mM to 60 mM, or 1 mM to 10 mM. In some instances, the concentration of the at least one salt is about 105 mM. In some instances, the concentration of the at least one salt is about 55 mM. In some instances, the concentration of the at least one salt is about 7 mM. In some instances, the solution comprises potassium acetate and magnesium acetate. In some instances, the solution comprises sodium chloride and magnesium chloride. In some instances, the solution comprises potassium chloride and magnesium chloride. In some instances, the salt is a magnesium salt and the concentration of magnesium in the solution is at least 5 mM, 7 mM, at least 9 mM, at least 11 mM, at least 13 mM, or at least 15 mM. In some instances, the concentration of magnesium is less than 20 mM, less than 18 mM or less than 16 mM.

In some instances, systems comprise a solution, wherein the solution comprises at least one crowding agent. A crowding agent may reduce the volume of solvent available for other molecules in the solution, thereby increasing the effective concentrations of said molecules. Exemplary crowding agents include glycerol and bovine serum albumin. In some instances, the crowding agent is glycerol. In some instances, the concentration of the crowding agent in the solution is 0.01% (v/v) to 10% (v/v). In some instances, the concentration of the crowding agent in the solution is 0.5% (v/v) to 10% (v/v).

In some instances, systems comprise a solution, wherein the solution comprises at least one detergent. Exemplary detergents include Tween, Triton-X, and IGEPAL. A solution may comprise Tween, Triton-X, or any combination thereof. A solution may comprise Triton-X. A solution may comprise IGEPAL CA-630. In some instances, the concentration of the detergent in the solution is 2% (v/v) or less. In some instances, the concentration of the detergent in the solution is 1% (v/v) or less. In some instances, the concentration of the detergent in the solution is 0.00001% (v/v) to 0.01% (v/v). In some instances, the concentration of the detergent in the solution is about 0.01% (v/v).

In some instances, systems comprise a solution, wherein the solution comprises at least one reducing agent. Exemplary reducing agents comprise dithiothreitol (DTT), ß-mercaptoethanol (BME), or tris(2-carboxyethyl) phosphine (TCEP). In some instances, the reducing agent is DTT. In some instances, the concentration of the reducing agent in the solution is 0.01 mM to 100 mM. In some instances, the concentration of the reducing agent in the solution is 0.1 mM to 10 mM. In some instances, the concentration of the reducing agent in the solution is 0.5 mM to 2 mM. In some instances, the concentration of the reducing agent in the solution is 0.01 mM to 100 mM. In some instances, the concentration of the reducing agent in the solution is 0.1 mM to 10 mM. In some instances, the concentration of the reducing agent in the solution is about 1 mM.

In some instances, systems comprise a solution, wherein the solution comprise a competitor. In general, competitors compete with the target nucleic acid or the reporter nucleic acid for cleavage by the effector protein or a dimer thereof. Exemplary competitors include heparin, and imidazole, and salmon sperm DNA. In some instances, the concentration of the competitor in the solution is 1 µg/mL to 100 µg/mL. In some instances, the concentration of the competitor in the solution is 40 µg/mL to 60 µg/mL.

In some instances, systems comprise a solution, wherein the solution comprise a co-factor. In some instances, the co-factor allows an effector protein or a multimeric complex thereof to perform a function, including pre-crRNA processing and/or target nucleic acid cleavage. The suitability of a cofactor for an effector protein or a multimeric complex thereof may be assessed, such as by methods based on those described by Sundaresan et al. (*Cell Rep.* 2017 Dec. 26; 21(13): 3728-3739). In some instances, an effector or a multimeric complex thereof forms a complex with a co-factor. In some instances, the co-factor is a divalent metal ion. In some instances, the divalent metal ion is selected from $Mg^{2+}$, $Mn^{2+}$, $Zn^{2+}$, $Ca^{2+}$, $Cu^{2+}$. In some instances, the divalent metal ion is $Mg^{2+}$. In some instances, the effector protein is a D2S effector protein and the co-factor is $Mg^{2+}$.

Reporters

In some embodiments, systems disclosed herein comprise a detection reagent and an amplification reagent. In some instances, a detection reagent comprises a reporter. In some embodiments, reporter and a reporter nucleic acid comprise a non-target nucleic acid molecule that can provide a detectable signal upon cleavage by an effector protein. In some instances, a detection reagent comprises an additional polypeptide. In some instances, a detection reagent comprises a detection moiety. In some instances, systems disclosed herein comprise a reporter. By way of non-limiting and illustrative example, a reporter may comprise a single stranded nucleic acid and a detection moiety (e.g., a labeled single stranded RNA reporter), wherein the nucleic acid is capable of being cleaved by an effector protein (e.g., a D2S CRISPR/Cas protein as disclosed herein) or a multimeric complex thereof, releasing the detection moiety, and, generating a detectable signal. As used herein, "reporter" is used interchangeably with "reporter nucleic acid" or "reporter molecule". The effector proteins disclosed herein, activated upon hybridization of a guide RNA to a target nucleic acid, may cleave the reporter. Cleaving the "reporter" may be referred to herein as cleaving the "reporter nucleic acid," the "reporter molecule," or the "nucleic acid of the reporter." Reporters may comprise RNA. Reporters may comprise DNA. Reporters may be double-stranded. Reporters may be single-stranded.

In some instances, reporters comprise a protein capable of generating a signal. A signal may be a calorimetric, potentiometric, amperometric, optical (e.g., fluorescent, colorimetric, etc.), or piezo-electric signal. In some instances, the reporter comprises a detection moiety. Suitable detectable labels and/or moieties that may provide a signal include, but are not limited to, an enzyme, a radioisotope, a member of a specific binding pair; a fluorophore; a fluorescent protein; a quantum dot; and the like.

In some instances, the reporter comprises a detection moiety and a quenching moiety. In some instances, the reporter comprises a cleavage site, wherein the detection moiety is located at a first site on the reporter and the quenching moiety is located at a second site on the reporter, wherein the first site and the second site are separated by the cleavage site. Sometimes the quenching moiety is a fluorescence quenching moiety. In some instances, the quenching moiety is 5' to the cleavage site and the detection moiety is 3' to the cleavage site. In some instances, the detection moiety is 5' to the cleavage site and the quenching moiety is 3' to the cleavage site. Sometimes the quenching moiety is at the 5' terminus of the nucleic acid of a reporter. Sometimes the detection moiety is at the 3' terminus of the nucleic acid of a reporter. In some instances, the detection moiety is at the 5' terminus of the nucleic acid of a reporter. In some instances, the quenching moiety is at the 3' terminus of the nucleic acid of a reporter.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilised EGFP (dEGFP), destabilised ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, *Renilla* GFP, Monster GFP, paGFP, Kaede protein and kindling protein, Phycobiliproteins and Phycobiliprotein conjugates including B-Phycoerythrin, R-Phycoerythrin and Allophycocyanin. Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, and glucose oxidase (GO).

In some instances, the detection moiety comprises an polypeptide. In some instances, the detection moiety comprises an invertase. The substrate of the invertase may be sucrose. A DNS reagent may be included in the system to produce a colorimetric change when the invertase converts sucrose to glucose. In some instances, the reporter nucleic acid and invertase are conjugated using a heterobifunctional linker via sulfo-SMCC chemistry.

Suitable fluorophores may provide a detectable fluorescence signal in the same range as 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). Non-limiting examples of fluorophores are fluorescein amidite, 6-Fluorescein, IRDye 700, TYE 665, Alex Fluor 594, or ATTO TM 633 (NHS Ester). The fluorophore may be an infrared fluorophore. The fluorophore may emit fluorescence in the range of 500 nm and 720 nm. In some instances, the fluorophore emits fluorescence at a wavelength of 700 nm or higher. In other cases, the fluorophore emits fluorescence at about 665 nm. In some instances, the fluorophore emits fluorescence in the range of 500 nm to 520 nm, 500 nm to 540 nm, 500 nm to 590 nm, 590 nm to 600 nm, 600 nm to 610 nm, 610 nm to 620 nm, 620 nm to 630 nm, 630 nm to 640 nm, 640 nm to 650 nm, 650 nm to 660 nm, 660 nm to 670 nm, 670 nm to 680 nm, 690 nm to 690 nm, 690 nm to 700 nm, 700 nm to 710 nm, 710 nm to 720 nm, or 720 nm to 730 nm. In some instances, the fluorophore emits fluorescence in the range 450 nm to 750 nm, 500 nm to 650 nm, or 550 to 650 nm.

Systems may comprise a quenching moiety. A quenching moiety may be chosen based on its ability to quench the detection moiety. A quenching moiety may be a non-fluorescent fluorescence quencher. A quenching moiety may quench a detection moiety that emits fluorescence in the range of 500 nm and 720 nm. A quenching moiety may quench a detection moiety that emits fluorescence in the range of 500 nm and 720 nm. In some instances, the quenching moiety quenches a detection moiety that emits fluorescence at a wavelength of 700 nm or higher. In other cases, the quenching moiety quenches a detection moiety that emits fluorescence at about 660 nm or about 670 nm. In some instances, the quenching moiety quenches a detection moiety that emits fluorescence in the range of 500 to 520, 500 to 540, 500 to 590, 590 to 600, 600 to 610, 610 to 620, 620 to 630, 630 to 640, 640 to 650, 650 to 660, 660 to 670, 670 to 680, 690 to 690, 690 to 700, 700 to 710, 710 to 720, or 720 to 730 nm. In some instances, the quenching moiety quenches a detection moiety that emits fluorescence in the range 450 nm to 750 nm, 500 nm to 650 nm, or 550 to 650 nm. A quenching moiety may quench fluorescein amidite, 6-Fluorescein, IRDye 700, TYE 665, Alex Fluor 594, or ATTO TM 633 (NHS Ester). A quenching moiety may be Iowa Black RQ, Iowa Black FQ or IRDye QC-1 Quencher. A quenching moiety may quench fluorescein amidite, 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). A quenching moiety may be Iowa Black RQ (Integrated DNA Technologies), Iowa Black FQ (Integrated DNA Technologies) or IRDye QC-1 Quencher (LiCor). Any of the quenching moieties described herein may be from any commercially available source, may be an alternative with a similar function, a generic, or a non-tradename of the quenching moieties listed.

The generation of the detectable signal from the release of the detection moiety indicates that cleavage by the effector protein has occurred and that the sample contains the target nucleic acid. In some instances, the detection moiety comprises a fluorescent dye. Sometimes the detection moiety comprises a fluorescence resonance energy transfer (FRET) pair. In some instances, the detection moiety comprises an infrared (IR) dye. In some instances, the detection moiety comprises an ultraviolet (UV) dye. Alternatively, or in combination, the detection moiety comprises a protein. Sometimes the detection moiety comprises a biotin. Sometimes the detection moiety comprises at least one of avidin or streptavidin. In some instances, the detection moiety comprises a polysaccharide, a polymer, or a nanoparticle. In some instances, the detection moiety comprises a gold nanoparticle or a latex nanoparticle.

A detection moiety may be any moiety capable of generating a calorimetric, potentiometric, amperometric, optical (e.g., fluorescent, colorimetric, etc.), or piezo-electric signal. A nucleic acid of a reporter, sometimes, is protein-nucleic acid that is capable of generating a calorimetric, potentiometric, amperometric, optical (e.g., fluorescent, colorimetric, etc.), or piezo-electric signal upon cleavage of the nucleic acid. Often a calorimetric signal is heat produced after cleavage of the nucleic acids of a reporter. Sometimes, a calorimetric signal is heat absorbed after cleavage of the nucleic acids of a reporter. A potentiometric signal, for example, is electrical potential produced after cleavage of the nucleic acids of a reporter. An amperometric signal may be movement of electrons produced after the cleavage of nucleic acid of a reporter. Often, the signal is an optical signal, such as a colorimetric signal or a fluorescence signal. An optical signal is, for example, a light output produced after the cleavage of the nucleic acids of a reporter. Sometimes, an optical signal is a change in light absorbance between before and after the cleavage of nucleic acids of a reporter. Often, a piezo-electric signal is a change in mass between before and after the cleavage of the nucleic acid of a reporter.

The detectable signal may be a colorimetric signal or a signal visible by eye. In some instances, the detectable signal may be fluorescent, electrical, chemical, electrochemical, or magnetic. In some instances, the first detection signal may be generated by binding of the detection moiety to the capture molecule in the detection region, where the first detection signal indicates that the sample contained the target nucleic acid. Sometimes systems are capable of detecting more than one type of target nucleic acid, wherein the system comprises more than one type of guide nucleic acid and more than one type of reporter nucleic acid. In some instances, the detectable signal may be generated directly by the cleavage event. Alternatively, or in combination, the detectable signal may be generated indirectly by the signal event. Sometimes the detectable signal is not a fluorescent signal. In some instances, the detectable signal may be a colorimetric or color-based signal. In some instances, the detected target nucleic acid may be identified based on its spatial location on the detection region of the support medium. In some instances, the second detectable signal may be generated in a spatially distinct location than the first generated signal.

In some instances, the reporter nucleic acid is a single-stranded nucleic acid sequence comprising ribonucleotides. The nucleic acid of a reporter may be a single-stranded nucleic acid sequence comprising at least one ribonucleotide. In some instances, the nucleic acid of a reporter is a single-stranded nucleic acid comprising at least one ribonucleotide residue at an internal position that functions as a cleavage site. In some instances, the nucleic acid of a reporter comprises at least 2, at least 3, at least 4, at least 5, at least 6, at least 7, at least 8, at least 9, or at least 10 ribonucleotide residues at an internal position. In some instances, the nucleic acid of a reporter comprises from 2 to 10, from 3 to 9, from 4 to 8, or from 5 to 7 ribonucleotide residues at an internal position. Sometimes the ribonucleotide residues are continuous. Alternatively, the ribonucleotide residues are interspersed in between non-ribonucleotide residues. In some instances, the nucleic acid of a reporter has only ribonucleotide residues. In some instances, the nucleic acid of a reporter has only deoxyribonucleotide residues. In some instances, the nucleic acid comprises nucleotides resistant to cleavage by the effector protein described herein. In some instances, the nucleic acid of a reporter comprises synthetic nucleotides. In some instances, the nucleic acid of a reporter comprises at least one ribonucleotide residue and at least one non-ribonucleotide residue.

In some instances, the nucleic acid of a reporter comprises at least one uracil ribonucleotide. In some instances, the nucleic acid of a reporter comprises at least two uracil ribonucleotides. Sometimes the nucleic acid of a reporter has only uracil ribonucleotides. In some instances, the nucleic acid of a reporter comprises at least one adenine ribonucleotide. In some instances, the nucleic acid of a reporter comprises at least two adenine ribonucleotide. In some instances, the nucleic acid of a reporter has only adenine ribonucleotides. In some instances, the nucleic acid of a reporter comprises at least one cytosine ribonucleotide. In some instances, the nucleic acid of a reporter comprises at least two cytosine ribonucleotide. In some instances, the nucleic acid of a reporter comprises at least one guanine ribonucleotide. In some instances, the nucleic acid of a reporter comprises at least two guanine ribonucleotide. In some instances, a nucleic acid of a reporter comprises a single unmodified ribonucleotide. In some instances, a nucleic acid of a reporter comprises only unmodified deoxyribonucleotides.

In some instances, the nucleic acid of a reporter is 5 to 20, 5 to 15, 5 to 10, 7 to 20, 7 to 15, or 7 to 10 nucleotides in length. In some instances, the nucleic acid of a reporter is 3 to 20, 4 to 10, 5 to 10, or 5 to 8 nucleotides in length. In some instances, the nucleic acid of a reporter is 5 to 12 nucleotides in length. In some instances, the reporter nucleic acid is at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 nucleotides in length. In some instances, the reporter nucleic acid is 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides in length.

In some instances, systems comprise a plurality of reporters. The plurality of reporters may comprise a plurality of signals. In some instances, systems comprise at least 2, at least 3, at least 4, at least 5, at least 6, at least 7, at least 8, at least 9, at least 10, at least 11, at least 12, at least 13, at least 14, at least 15, at least 20, at least 30, at least 40, or at least 50 reporters. In some instances, there are 2 to 50, 3 to 40, 4 to 30, 5 to 20, or 6 to 10 different reporters.

In some instances, systems comprise a D2S effector protein and a reporter nucleic acid configured to undergo transcollateral cleavage by the D2S effector protein. Transcollateral cleavage of the reporter may generate a signal from reporter or alter a signal from the reporter. In some instances, the signal is an optical signal, such as a fluorescence signal or absorbance band. Transcollateral cleavage of the reporter may alter the wavelength, intensity, or polarization of the optical signal. For example, the reporter may comprise a fluorophore and a quencher, such that transcollateral cleavage of the reporter separates the fluorophore and the quencher thereby increasing a fluorescence signal from the fluorophore. Herein, detection of reporter cleavage to determine the presence of a target nucleic acid sequence may be referred to as 'DETECTR'. In some instances described herein is a method of assaying for a target nucleic acid in a sample comprising contacting the target nucleic acid with an effector protein, a non-naturally occurring guide nucleic acid that hybridizes to a segment of the target nucleic acid, and a reporter nucleic acid, and assaying for a change in a signal, wherein the change in the signal is produced by cleavage of the reporter nucleic acid.

In the presence of a large amount of non-target nucleic acids, an activity of an effector protein (e.g., a D2S effector protein as disclosed herein) may be inhibited. This is because the activated effector proteins collaterally cleave any nucleic acids. If total nucleic acids are present in large amounts, they may outcompete reporters for the effector proteins. In some instances, systems comprise an excess of reporter(s), such that when the system is operated and a solution of the system comprising the reporter is combined with a sample comprising a target nucleic acid, the concentration of the reporter in the combined solution-sample is greater than the concentration of the target nucleic acid. In some instances, the sample comprises amplified target nucleic acid. In some instances, the sample comprises an unamplified target nucleic acid. In some instances, the concentration of the reporter is greater than the concentration of target nucleic acids and non-target nucleic acids. The non-target nucleic acids may be from the original sample, either lysed or unlysed. The non-target nucleic acids may comprise byproducts of amplification. In some instances, systems comprise a reporter wherein the concentration of the reporter in a solution 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold excess of total nucleic acids. 1.5 fold to 100 fold, 2 fold to 10 fold, 10 fold to 20 fold, 20 fold to 30 fold, 30 fold to 40 fold, 40 fold to 50 fold, 50 fold to 60 fold, 60 fold to 70 fold, 70 fold to 80 fold, 80 fold to 90 fold, 90 fold to 100 fold, 1.5 fold to 10 fold, 1.5 fold to 20 fold, 10 fold to 40 fold, 20 fold to 60 fold, or 10 fold to 80 fold excess of total nucleic acids.

Amplification Reagents/Components

In some instances, systems described herein comprise a reagent or component for amplifying a nucleic acid. In some embodiments, amplification and amplifying or grammatical equivalents thereof, comprise a process by which a nucleic acid molecule is enzymatically copied to generate a plurality of nucleic acid molecules containing the same sequence as the original nucleic acid molecule or a distinguishable portion thereof. Non-limiting examples of reagents for amplifying a nucleic acid include polymerases, primers, and nucleotides (e.g., dNTPs or rNTPs). In some instances, systems comprise reagents for nucleic acid amplification of a target nucleic acid in a sample. Nucleic acid amplification of the target nucleic acid may improve at least one of sensitivity, specificity, or accuracy of the assay in detecting the target nucleic acid. In some instances, nucleic acid amplification is isothermal nucleic acid amplification, providing for the use of the system or system in remote regions or low resource settings without specialized equipment for amplification. In some instances, amplification of the target nucleic acid increases the concentration of the target nucleic acid in the sample relative to the concentration of nucleic acids that do not correspond to the target nucleic acid.

The reagents for nucleic acid amplification may comprise a recombinase, an oligonucleotide primer, a single-stranded DNA binding (SSB) protein, a polymerase, or a combination thereof that is suitable for an amplification reaction. Non-limiting examples of amplification reactions are transcription mediated amplification (TMA), helicase dependent amplification (HDA), or circular helicase dependent amplification (cHDA), strand displacement amplification (SDA), recombinase polymerase amplification (RPA), loop mediated amplification (LAMP), exponential amplification reaction (EXPAR), rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), and improved multiple displacement amplification (IMDA).

In some instances, systems comprise a PCR tube, a PCR well or a PCR plate. The wells of the PCR plate may be pre-aliquoted with the reagent for amplifying a nucleic acid, as well as a guide nucleic acid, an effector protein, a multimeric complex, or any combination thereof. The wells of the PCR plate may be pre-aliquoted with a guide nucleic acid targeting a target sequence, an effector protein capable of being activated when complexed with the guide nucleic acid and the target sequence, and at least one population of a single stranded reporter nucleic acid comprising a detection moiety. A user may thus add the biological sample of interest to a well of the pre-aliquoted PCR plate and measure for the detectable signal with a fluorescent light reader or a visible light reader.

In some instances, systems comprise a PCR plate; a guide nucleic acid targeting a target sequence; an effector protein capable of being activated when complexed with the guide nucleic acid and the target sequence; and a single stranded reporter nucleic acid comprising a detection moiety, wherein the reporter nucleic acid is capable of being cleaved by the activated nuclease, thereby generating a detectable signal.

In some instances, systems comprise a support medium; a guide nucleic acid targeting a target sequence; and an effector protein capable of being activated when complexed with the guide nucleic acid and the target sequence. In some instances, nucleic acid amplification is performed in a nucleic acid amplification region on the support medium.

Alternatively, or in combination, the nucleic acid amplification is performed in a reagent chamber, and the resulting sample is applied to the support medium.

In some instances, a system for modifying a target nucleic acid comprises a PCR plate; a guide nucleic acid targeting a target sequence; and an effector protein capable of being activated when complexed with the guide nucleic acid and the target sequence. The wells of the PCR plate may be pre-aliquoted with the guide nucleic acid targeting a target sequence, and an effector protein capable of being activated when complexed with the guide nucleic acid and the target sequence. A user may thus add the biological sample of interest to a well of the pre-aliquoted PCR plate.

Often, the nucleic acid amplification is performed for no greater than 1, 2, 3, 4, 5, 6, 7, 8, 9, 10, 11, 12, 13, 14, 15, 16, 17, 18, 19, 20, 25, 30, 40, 50, or 60 minutes, or any value 1 to 60 minutes. Sometimes, the nucleic acid amplification is performed for 1 to 60, 5 to 55, 10 to 50, 15 to 45, 20 to 40, or 25 to 35 minutes. Sometimes, the nucleic acid amplification reaction is performed at a temperature of around 20-45° C. In some instances, the nucleic acid amplification reaction is performed at a temperature no greater than 20° C., 25° C., 30° C., 35° C., 37° C., 40° C., 45° C., or any value 20° C. to 45° C. In some instances, the nucleic acid amplification reaction is performed at a temperature of at least 20° C., 25° C., 30° C., 35° C., 37° C., 40° C., or 45° C., or any value 20° C. to 45° C. In some instances, the nucleic acid amplification reaction is performed at a temperature of 20° C. to 45° C., 25° C. to 40° C., 30° C. to 40° C., or 35° C. to 40° C.

Often, systems comprise primers for amplifying a target nucleic acid to produce an amplification product comprising the target nucleic acid and a PAM. For instance, at least one of the primers may comprise the PAM that is incorporated into the amplification product during amplification. The compositions for amplification of target nucleic acids and methods of use thereof, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence.

Additional System Components

In some instances, systems include a package, carrier, or container that is compartmentalized to receive one or more containers such as vials, tubes, and the like, each of the container(s) comprising one of the separate elements to be used in a method described herein. Suitable containers include, for example, test wells, bottles, vials, and test tubes. In one embodiment, the containers are formed from a variety of materials such as glass, plastic, or polymers. The system or systems described herein contain packaging materials. Examples of packaging materials include, but are not limited to, pouches, blister packs, bottles, tubes, bags, containers, bottles, and any packaging material suitable for intended mode of use.

A system may include labels listing contents and/or instructions for use, or package inserts with instructions for use. A set of instructions will also typically be included. In one embodiment, a label is on or associated with the container. In some instances, a label is on a container when letters, numbers or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein. After packaging the formed product and wrapping or boxing to maintain a sterile barrier, the product may be terminally sterilized by heat sterilization, gas sterilization, gamma irradiation, or by electron beam sterilization. Alternatively, the product may be prepared and packaged by aseptic processing.

In some instances, systems comprise a solid support. An RNP or effector protein may be attached to a solid support. The solid support may be an electrode or a bead. The bead may be a magnetic bead. Upon cleavage, the RNP is liberated from the solid support and interacts with other mixtures. For example, upon cleavage of the nucleic acid of the RNP, the effector protein of the RNP flows through a chamber into a mixture comprising a substrate. When the effector protein meets the substrate, a reaction occurs, such as a colorimetric reaction, which is then detected. As another example, the protein is an enzyme substrate, and upon cleavage of the nucleic acid of the enzyme substrate-nucleic acid, the enzyme flows through a chamber into a mixture comprising the enzyme. When the enzyme substrate meets the enzyme, a reaction occurs, such as a colorimetric reaction, which is then detected.

Certain System Conditions

In some instances, systems and methods are employed under certain conditions that enhance an activity of the effector protein relative to alternative conditions, as measured by a detectable signal released from cleavage of a reporter in the presence of the target nucleic acid. The detectable signal may be generated at about the rate of transcollateral cleavage of a reporter nucleic acid. In some instances, the reporter nucleic acid is a homopolymeric reporter nucleic acid comprising 5 to 20 consecutive adenines (SEQ ID NO: 945), 5 to 20 consecutive thymines (SEQ ID NO: 946), 5 to 20 consecutive cytosines (SEQ ID NO: 947), or 5 to 20 consecutive guanines (SEQ ID NO: 948). In some instances, the reporter is an RNA-FQ reporter.

In some instances, effector proteins disclosed herein recognize, bind, or are activated by, different target nucleic acids having different sequences, but are active toward the same reporter nucleic acid, allowing for facile multiplexing in a single assay having a single ssRNA-FQ reporter.

In some instances, systems are employed under certain conditions that enhance transcollateral cleavage activity of an effector protein. In some instances, under certain conditions, transcolatteral cleavage occurs at a rate of at least 0.005 mmol/min, at least 0.01 mmol/min, at least 0.05 mmol/min, at least 0.1 mmol/min, at least 0.2 mmol/min, at least 0.5 mmol/min, or at least 1 mmol/min. In some instances, systems and methods are employed under certain conditions that enhance cis-cleavage activity of the effector protein.

Certain conditions that may enhance the activity of an effector protein include a certain salt presence or salt concentration of the solution in which the activity occurs. For example, cis-cleavage activity of an effector protein may be inhibited or halted by a high salt concentration. The salt may be a sodium salt, a potassium salt, or a magnesium salt. In some instances, the salt is NaCl. In some instances, the salt is $KNO_3$. In some instances, the salt concentration is less than 150 mM, less than 125 mM, less than 100 mM, less than 75 mM, less than 50 mM, or less than 25 mM.

Certain conditions that may enhance the activity of an effector protein includes the pH of a solution in which the activity. For example, increasing pH may enhance transcollateral activity. For example, the rate of transcollateral activity may increase with increase in pH up to pH 9. In some instances, the pH is about 7, about 7.1, about 7.2, about 7.3, about 7.4, about 7.5, about 7.6, about 7.7, about 7.8, about 7.9, about 8, about 8.1, about 8.2, about 8.3, about 8.4, about 8.5, about 8.6, about 8.7, about 8.8, about 8.9, or about 9. In some instances, the pH is 7 to 7.5, 7.5 to 8, 8 to 8.5, 8.5 to 9, or 7 to 8.5. In some instances, the pH is less than 7. In some instances, the pH is greater than 7.

Certain conditions that may enhance the activity of an effector protein includes the temperature at which the activity is performed. In some instances, the temperature is about 25° C. to about 50° C. In some instances, the temperature is about 20° C. to about 40° C., about 30° C. to about 50° C., or about 40° C. to about 60° C. In some instances, the temperature is about 25° C., about 30° C., about 35° C., about 40° C., about 45° C., or about 50° C.

In some instances, a final concentration an effector protein in a buffer of a system is 1 pM to 1 nM, 1 pM to 10 pM, 10 pM to 100 pM, 100 pM to 1 nM, 1 nM to 10 nM, 10 nM to 20 nM, 20 nM to 30 nM, 30 nM to 40 nM, 40 nM to 50 nM, 50 nM to 60 nM, 60 nM to 70 nM, 70 nM to 80 nM, 80 nM to 90 nM, 90 nM to 100 nM, 100 nM to 200 nM, 200 nM to 300 nM, 300 nM to 400 nM, 400 nM to 500 nM, 500 nM to 600 nM, 600 nM to 700 nM, 700 nM to 800 nM, 800 nM to 900 nM, 900 nM to 1000 nM. The final concentration of the sgRNA complementary to the target nucleic acid may be 1 pM to 1 nM, 1 pM to 10 pM, 10 pM to 100 pM, 100 pM to 1 nM, 1 nM to 10 nM, 10 nM to 20 nM, 20 nM to 30 nM, 30 nM to 40 nM, 40 nM to 50 nM, 50 nM to 60 nM, 60 nM to 70 nM, 70 nM to 80 nM, 80 nM to 90 nM, 90 nM to 100 nM, 100 nM to 200 nM, 200 nM to 300 nM, 300 nM to 400 nM, 400 nM to 500 nM, 500 nM to 600 nM, 600 nM to 700 nM, 700 nM to 800 nM, 800 nM to 900 nM, 900 nM to 1000 nM. The concentration of the ssDNA-FQ reporter may be 1 pM to 1 nM, 1 pM to 10 pM, 10 pM to 100 pM, 100 pM to 1 nM, 1 nM to 10 nM, 10 nM to 20 nM, 20 nM to 30 nM, 30 nM to 40 nM, 40 nM to 50 nM, 50 nM to 60 nM, 60 nM to 70 nM, 70 nM to 80 nM, 80 nM to 90 nM, 90 nM to 100 nM, 100 nM to 200 nM, 200 nM to 300 nM, 300 nM to 400 nM, 400 nM to 500 nM, 500 nM to 600 nM, 600 nM to 700 nM, 700 nM to 800 nM, 800 nM to 900 nM, 900 nM to 1000 nM.

In some instances, systems comprise an excess volume of solution comprising the guide nucleic acid, the effector protein and the reporter, which contacts a smaller volume comprising a sample with a target nucleic acid. The smaller volume comprising the sample may be unlysed sample, lysed sample, or lysed sample which has undergone any combination of reverse transcription, amplification, and in vitro transcription. The presence of various reagents, (such as buffer, magnesium sulfate, salts, the pH, a reducing agent, primers, dNTPs, NTPs, cellular lysates, non-target nucleic acids, primers, or other components), in a crude, non-lysed sample, a lysed sample, or a lysed and amplified sample, may inhibit the ability of the effector protein to become activated or to find and cleave the nucleic acid of the reporter. This may be due to nucleic acids that are not the reporter outcompeting the nucleic acid of the reporter, for the effector protein. Alternatively, various reagents in the sample may simply inhibit the activity of the effector protein. Thus, the compositions and methods provided herein for contacting an excess volume comprising the engineered guide nucleic acid, the effector protein, and the reporter to a smaller volume comprising the sample with the target nucleic acid of interest provides for superior detection of the target nucleic acid by ensuring that the effector protein is able to find and cleaves the nucleic acid of the reporter. In some instances, the volume comprising the guide nucleic acid, the effector protein, and the reporter (may be referred to as "a second volume") is 4-fold greater than a volume comprising the sample (may be referred to as "a first volume"). In some instances, the volume comprising the guide nucleic acid, the effector protein, and the reporter (may be referred to as "a second volume") is at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold, 1.5 fold to 100 fold, 2 fold to 10 fold, 10 fold to 20 fold, 20 fold to 30 fold, 30 fold to 40 fold, 40 fold to 50 fold, 50 fold to 60 fold, 60 fold to 70 fold, 70 fold to 80 fold, 80 fold to 90 fold, 90 fold to 100 fold, 1.5 fold to 10 fold, 1.5 fold to 20 fold, 10 fold to 40 fold, 20 fold to 60 fold, or 10 fold to 80 fold greater than a volume comprising the sample (may be referred to as "a first volume"). In some instances, the volume comprising the sample is at least 0.5 µL, at least 1 µL, at least at least 1 µL, at least 2 µL, at least 3 µL, at least 4 µL, at least 5 µL, at least 6 µL, at least 7 µL, at least 8 µL, at least 9 µL, at least 10 µL, at least 11 µL, at least 12 µL, at least 13 µL, at least 14 µL, at least 15 µL, at least 16 µL, at least 17 µL, at least 18 µL, at least 19 µL, at least 20 µL, at least 25 µL, at least 30 µL, at least 35 µL, at least 40 µL, at least 45 µL, at least 50 µL, at least 55 µL, at least 60 µL, at least 65 µL, at least 70 µL, at least 75 µL, at least 80 µL, at least 85 µL, at least 90 µL, at least 95 µL, at least 100 µL, 0.5 µL to 5 µL µL, 5 µL to 10 µL, 10 µL to 15 µL, 15 µL to 20 µL, 20 µL to 25 µL, 25 µL to 30 µL, 30 µL to 35 µL, 35 µL to 40 µL, 40 µL to 45 µL, 45 µL to 50 µL, 10 µL to 20 µL, 5 µL to 20 µL, 1 µL to 40 µL, 2 µL to 10 µL, or 1 µL to 10 µL. In some instances, the volume comprising the effector protein, the guide nucleic acid, and the reporter is at least 10 µL, at least 11 µL, at least 12 µL, at least 13 µL, at least 14 µL, at least 15 µL, at least 16 µL, at least 17 µL, at least 18 µL, at least 19 µL, at least 20 µL, at least 21 µL, at least 22 µL, at least 23 µL, at least 24 µL, at least 25 µL, at least 26 µL, at least 27 µL, at least 28 µL, at least 29 µL, at least 30 µL, at least 40 µL, at least 50 µL, at least 60 µL, at least 70 µL, at least 80 µL, at least 90 µL, at least 100 µL, at least 150 µL, at least 200 µL, at least 250 µL, at least 300 µL, at least 350 µL, at least 400 µL, at least 450 µL, at least 500 µL, 10 µL to 15 µL µL, 15 µL to 20 µL, 20 µL to 25 µL, 25 µL to 30 µL, 30 µL to 35 µL, 35 µL to 40 µL, 40 µL to 45 µL, 45 µL to 50 µL, 50 µL to 55 µL, 55 µL to 60 µL, 60 µL to 65 µL, 65 µL to 70 µL, 70 µL to 75 µL, 75 µL to 80 µL, 80 µL to 85 µL, 85 µL to 90 µL, 90 µL to 95 µL, 95 µL to 100 µL, 100 µL to 150 µL, 150 µL to 200 µL, 200 µL to 250 µL, 250 µL to 300 µL, 300 µL to 350 µL, 350 µL to 400 µL, 400 µL to 450 µL, 450 µL to 500 µL, 10 µL to 20 µL, 10 µL to 30 µL, 25 µL to 35 µL, 10 µL to 40 µL, 20 µL to 50 µL, 18 µL to 28 µL, or 17 µL to 22 µL.

In some instances, systems comprise an effector protein that nicks a target nucleic acid, thereby producing a nicked product. In some instances, systems cleave a target nucleic acid, thereby producing a linearized product. In some instances, systems produce at least 50%, at least 55%, at least 60%, at least 65%, at least 70%, at least 75%, at least 80%, at least 85%, at least 90 or at least 95% of a maximum amount of nicked product within 1 minute, where the maximum amount of nicked product is the maximum amount detected within a 60 minute period from when the target nucleic acid is mixed with the effector protein or the multimeric complex thereof. In some instances, systems produce at least 50%, at least 55%, at least 60%, at least 65%, at least 70%, at least 75%, at least 80%, at least 85%, at least 90 or at least 95% of a maximum amount of linearized product within 1 minute, where the maximum amount of linearized product is the maximum amount detected within a 60 minute period from when the target nucleic acid is mixed with the effector protein. In some instances, at least 80% of the maximum amount of linearized product is produced within 1 minute. In some instances, at least 90% of the maximum amount of linearized product is produced within 1 minute.

X. Methods and Formulations for Introducing Systems and Compositions into a Target Cell A guide RNA (or a nucleic acid comprising a nucleotide sequence encoding same) and/or an effector protein described herein can be introduced into a host cell by any of a variety of well-known methods. As a non-limiting example, a guide RNA and/or effector protein can be combined with a lipid. As another non-limiting example, a guide RNA and/or effector protein can be combined with a particle, or formulated into a particle.

Methods for Introducing Systems and Compositions to a Host

Described herein are methods of introducing various components described herein to a host. A host can be any suitable host, such as a host cell. When described herein, a host cell can be an in vivo or in vitro eukaryotic cell, a prokaryotic cell (e.g., bacterial or archaeal cell), or a cell from a multicellular organism (e.g., a cell line) cultured as a unicellular entity, which eukaryotic or prokaryotic cells can be, or have been, used as recipients for methods of introduction described herein, and include the progeny of the original cell which has been transformed by the methods of introduction described herein. It is understood that the progeny of a single cell may not necessarily be completely identical in morphology or in genomic or total DNA complement as the original parent, due to natural, accidental, or deliberate mutation. A host cell can be a recombinant host cell or a genetically modified host cell, if a heterologous nucleic acid, e.g., an expression vector, has been introduced into the cell.

Methods of introducing a nucleic acid and/or protein into a host cell are known in the art, and any convenient method can be used to introduce a subject nucleic acid (e.g., an expression construct/vector) into a target cell (e.g., a human cell, and the like). Suitable methods include, e.g., viral infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et al. Adv Drug Deliv Rev. 2012 Sep. 13. pii: 50169-409X(12)00283-9. doi: 10.1016/j.addr.2012.09.023), and the like. In some instances, the nuclei acid and/or protein are introduced into a disease cell comprised in a pharmaceutical composition comprising the guide RNA and/or D2S effector protein and a pharmaceutically acceptable excipient.

In certain embodiments, molecules of interest, such as nucleic acids of interest, are introduced to a host. In certain embodiments, polypeptides, such as a effector protein are introduced to a host. In certain embodiments, vectors, such as lipid particles and/or viral vectors can be introduced to a host. Introduction can be for contact with a host or for assimilation into the host, for example, introduction into a host cell.

In some instances, described herein are methods of introducing one or more nucleic acids, such as a nucleic acid encoding a effector protein, a nucleic acid encoding an engineered guide nucleic acid, and/or a donor nucleic acid, or combinations thereof, into a host cell. Any suitable method can be used to introduce a nucleic acid into a cell. Suitable methods include, for example, viral infection, transfection, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct microinjection, nanoparticle-mediated nucleic acid delivery, and the like. Further methods are described throughout.

Introducing one or more nucleic acids into a host cell can occur in any culture media and under any culture conditions that promote the survival of the cells. Introducing one or more nucleic acids into a host cell can be carried out in vivo or ex vivo. Introducing one or more nucleic acids into a host cell can be carried out in vitro.

In some embodiments, a effector protein can be provided as RNA. The RNA can be provided by direct chemical synthesis or may be transcribed in vitro from a DNA (e.g., encoding the effector protein). Once synthesized, the RNA may be introduced into a cell by way of any suitable technique for introducing nucleic acids into cells (e.g., microinjection, electroporation, transfection, etc.). In some embodiments, introduction of one or more nucleic acid can be through the use of a vector and/or a vector system, accordingly, in some embodiments, compositions and system described herein comprise a vector and/or a vector system.

Vectors may be introduced directly to a host. In certain embodiments, host cells can be contacted with one or more vectors as described herein, and in certain embodiments, said vectors are taken up by the cells. Methods for contacting cells with vectors include but are not limited to electroporation, calcium chloride transfection, microinjection, lipofection, micro-injection, contact with the cell or particle that comprises a molecule of interest, or a package of cells or particles that comprise molecules of interest.

Components described herein can also be introduced directly to a host. For example, an engineered guide nucleic acid can be introduced to a host, specifically introduced into a host cell. Methods of introducing nucleic acids, such as RNA into cells include, but are not limited to direct injection, transfection, or any other method used for the introduction of nucleic acids.

Polypeptides (e.g., effector proteins) described herein can also be introduced directly to a host. In some embodiments, polypeptides described herein can be modified to promote introduction to a host. For example, polypeptides described herein can be modified to increase the solubility of the polypeptide. Such a polypeptide may optionally be fused to a polypeptide domain that increases solubility. The domain may be linked to the polypeptide through a defined protease cleavage site, such as TEV sequence which is cleaved by TEV protease. The linker may also include one or more flexible sequences, e.g. from 1 to 10 glycine residues. In some embodiments, the cleavage of the polypeptide is performed in a buffer that maintains solubility of the product, e.g. in the presence of from 0.5 to 2 M urea, in the presence of polypeptides and/or polynucleotides that increase solubility, and the like. Domains of interest include endosomolytic domains, e.g. influenza HA domain; and other polypeptides that aid in production, e.g. IF2 domain, GST domain, GRPE domain, and the like. In another example, the polypeptide can be modified to improve stability. For example, the polypeptides may be PEGylated, where the polyethyleneoxy group provides for enhanced lifetime in the blood stream. Polypeptides can also be modified to promote uptake by a host, such as a host cell. For example, a polypeptide described herein can be fused to a polypeptide permeant domain to promote uptake by a host cell. Any suitable permeant domains can be used in the non-integrating polypeptides of the present disclosure, including peptides, peptidomimetics, and non-peptide carriers. Examples include penetratin, a permeant peptide may be derived from the third alpha helix of *Drosophila melanogaster* transcription factor Antennapaedia; the HIV-1 t at basic region amino acid sequence, e.g., amino acids 49-57 of a naturally-occurring tat protein; and poly-arginine motifs, for example, the region of amino acids 34-56 of HIV-1 rev protein, nonaarginine, octa-arginine, and the like. The site at which the fusion is made may be selected in order to optimize the biological activity, secretion or binding characteristics of the polypeptide. The optimal site can be determined by suitable methods.

Formulations for Introducing Systems and Compositions to a Host

Described herein are formulations of introducing systems and compositions described herein to a host. In some embodiments, such formulations, systems and compositions described herein comprise an effector protein and a carrier (e.g., excipient, diluent, vehicle, or filling agent).

In some aspects of the present invention the effector protein is provided in a pharmaceutical composition comprising the effector protein and any pharmaceutically acceptable excipient, carrier, or diluent. In some embodiments, a pharmaceutically acceptable excipient, carrier or diluent can describe any substance formulated alongside the active ingredient of a pharmaceutical composition that allows the active ingredient to retain biological activity and is non-reactive with the subject's immune system. Such a substance can be included for the purpose of long-term stabilization, bulking up solid formulations that contain potent active ingredients in small amounts, or to confer a therapeutic enhancement on the active ingredient in the final dosage form, such as facilitating absorption, reducing viscosity, or enhancing solubility. The selection of appropriate substance can depend upon the route of administration and the dosage form, as well as the active ingredient and other factors. Compositions having such substances can be formulated by well-known conventional methods (see, e.g., Remington's Pharmaceutical Sciences, 18th edition, A. Gennaro, ed., Mack Publishing Co., Easton, Pa., 1990; and Remington, The Science and Practice of Pharmacy 21st Ed. Mack Publishing, 2005).

In some embodiments, a pharmaceutically acceptable excipient, carrier or diluent, comprises any substance formulated alongside the active ingredient of a pharmaceutical composition that allows the active ingredient to retain biological activity and is non-reactive with the subject's immune system. Such a substance can be included for the purpose of long-term stabilization, bulking up solid formulations that contain potent active ingredients in small amounts, or to confer a therapeutic enhancement on the active ingredient in the final dosage form, such as facilitating absorption, reducing viscosity, or enhancing solubility. The selection of appropriate substance can depend upon the route of administration and the dosage form, as well as the active ingredient and other factors. Compositions having such substances can be formulated by well-known conventional methods (see, e.g., Remington's Pharmaceutical Sciences, 18th edition, A. Gennaro, ed., Mack Publishing Co., Easton, Pa., 1990; and Remington, The Science and Practice of Pharmacy 21st Ed. Mack Publishing, 2005).

XI. Pharmaceutical Compositions and Modes of Delivery

Disclosed herein, in some aspects, are pharmaceutical compositions for modifying a target nucleic acid in a cell or a subject, comprising any one of the effector proteins, engineered effector proteins, fusion effector proteins, or guide nucleic acids as described herein and any combination thereof. In some embodiments, a subject can be a biological entity containing expressed genetic materials. The biological entity can be a plant, animal, or microorganism, including, for example, bacteria, viruses, fungi, and protozoa. The subject can be tissues, cells and their progeny of a biological entity obtained in vivo or cultured in vitro. The subject can be a mammal. The mammal can be a human. The subject may be diagnosed or suspected of being at high risk for a disease. In some instances, the subject is not necessarily diagnosed or suspected of being at high risk for the disease.

Also disclosed herein, in some aspects, are pharmaceutical compositions comprising a nucleic acid encoding any one of the effector proteins, engineered effector proteins, fusion effector proteins, or guide nucleic acids as described herein and any combination thereof. In some embodiments, pharmaceutical compositions comprise a plurality of guide nucleic acids. Pharmaceutical compositions may be used to modify a target nucleic acid or the expression thereof in a cell in vitro, in vivo or ex vivo.

In some embodiments, pharmaceutical compositions comprise one or more nucleic acids encoding a effector protein, fusion effector protein, fusion partner, a guide nucleic acid, or a combination thereof; and a pharmaceutically acceptable excipient, carrier or diluent.

The effector protein, fusion effector protein, fusion partner protein, or combination thereof may be any one of those described herein. The one or more nucleic acids may comprise a plasmid. The one or more nucleic acids may comprise a nucleic acid expression vector. The one or more nucleic acids may comprise a viral vector. In some embodiments, the viral vector is a lentiviral vector. In some embodiments, the vector is an adeno-associated viral (AAV) vector. In some embodiments, compositions, including pharmaceutical compositions, comprise a viral vector encoding a fusion effector protein and a guide nucleic acid, wherein at least a portion of the guide nucleic acid binds to the effector protein of the fusion effector protein.

In some embodiments, pharmaceutical compositions comprise a virus comprising a viral vector encoding a fusion effector protein, an effector protein, a fusion partner, a guide nucleic acid, or a combination thereof; and a pharmaceutically acceptable carrier or diluent. The virus may be a lentivirus. The virus may be an adenovirus. The virus may be a non-replicating virus. The virus may be an adeno-associated virus (AAV). The viral vector may be a retroviral vector. Retroviral vectors may include gamma-retroviral vectors such as vectors derived from the Moloney Murine Leukemia Virus (MoMLV, MMLV, MuLV, or MLV) or the Murine Stem cell Virus (MSCV) genome. Retroviral vectors may include lentiviral vectors such as those derived from the human immunodeficiency virus (HIV) genome. In some embodiments, the viral vector is a chimeric viral vector, comprising viral portions from two or more viruses. In some embodiments, the viral vector is a recombinant viral vector.

In some embodiments, when describing recombinant proteins, polypeptides, peptides and nucleic acids can describe proteins, polypeptides, peptides and nucleic acids that are products of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions and may act to modulate production of a desired product by various mechanisms. Thus, for example, a recombinant polynucleotide or a recombinant nucleic acid can describe one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. Similarly, a recombinant polypeptide or recombinant protein a can describe one which is not naturally occurring, e.g., is made by the artificial combination of two otherwise separated segments of amino sequences through human intervention. Thus, for example, a polypeptide that includes a heterologous amino acid sequence is a recombinant polypeptide.

In some embodiments, the viral vector is an AAV. The AAV may be any AAV known in the art. In some embodiments, the viral vector corresponds to a virus of a specific serotype. In some examples, the serotype is selected from an AAV1 serotype, an AAV2 serotype, AAV3 serotype, an AAV4 serotype, AAV5 serotype, an AAV6 serotype, AAV7 serotype, an AAV8 serotype, an AAV9 serotype, an AAV10 serotype, an AAV11 serotype, and an AAV12 serotype. In some embodiments the AAV vector is a recombinant vector, a hybrid AAV vector, a chimeric AAV vector, a self-complementary AAV (scAAV) vector, a single-stranded AAV or any combination thereof scAAV genomes are generally known in the art and contain both DNA strands which can anneal together to form double-stranded DNA.

In some embodiments, methods of producing delivery vectors herein comprise packaging a nucleic acid encoding an effector protein and a guide nucleic acid, or a combination thereof, into an AAV vector. In some embodiments, methods of producing the delivery vector comprises, (a) contacting a cell with at least one nucleic acid encoding: (i) a guide nucleic acid; (ii) a Replication (Rep) gene; and (iii) a Capsid (Cap) gene that encodes an AAV capsid protein; (b) expressing the AAV capsid protein in the cell; (c) assembling an AAV particle; and (d) packaging a Cas effector encoding nucleic acid into the AAV particle, thereby generating an AAV delivery vector. In some embodiments, promoters, stuffer sequences, and any combination thereof may be packaged in the AAV vector. In some examples, the AAV vector can package 1, 2, 3, 4, or 5 guide nucleic acids or copies thereof. In some embodiments, the AAV vector comprises inverted terminal repeats, e.g., a 5' inverted terminal repeat and a 3' inverted terminal repeat. In some embodiments, the AAV vector comprises a mutated inverted terminal repeat that lacks a terminal resolution site.

In some embodiments, a hybrid AAV vector is produced by transcapsidation, e.g., packaging an inverted terminal repeat (ITR) from a first serotype into a capsid of a second serotype, wherein the first and second serotypes may be not the same. In some examples, the Rep gene and ITR from a first AAV serotype (e.g., AAV2) may be used in a capsid from a second AAV serotype (e.g., AAV9), wherein the first and second AAV serotypes may be not the same. As a non-limiting example, a hybrid AAV serotype comprising the AAV2 ITRs and AAV9 capsid protein may be indicated AAV2/9. In some examples, the hybrid AAV delivery vector comprises an AAV2/1, AAV2/2, AAV 2/4, AAV2/5, AAV2/8, or AAV2/9 vector.

In some embodiments, the AAV vector may be a chimeric AAV vector. In some embodiments, the chimeric AAV vector comprises an exogenous amino acid or an amino acid substitution, or capsid proteins from two or more serotypes. In some examples, a chimeric AAV vector may be genetically engineered to increase transduction efficiency, selectivity, or a combination thereof.

In some examples, the delivery vector may be a eukaryotic vector, a prokaryotic vector (e.g., a bacterial vector) a viral vector, or any combination thereof. In some embodiments, the delivery vehicle may be a non-viral vector. In some embodiments, the delivery vehicle may be a plasmid. In some embodiments, the plasmid comprises DNA. In some embodiments, the plasmid comprises RNA. In some examples, the plasmid comprises circular double-stranded DNA. In some examples, the plasmid may be linear. In some examples, the plasmid comprises one or more genes of interest and one or more regulatory elements. In some examples, the plasmid comprises a bacterial backbone containing an origin of replication and an antibiotic resistance gene or other selectable marker for plasmid amplification in bacteria. In some examples, the plasmid may be a minicircle plasmid. In some examples, the plasmid contains one or more genes that provide a selective marker to induce a target cell to retain the plasmid. In some examples, the plasmid may be formulated for delivery through injection by a needle carrying syringe. In some examples, the plasmid may be formulated for delivery via electroporation. In some examples, the plasmids may be engineered through synthetic or other suitable means known in the art. For example, in some embodiments, the genetic elements may be assembled by restriction digest of the desired genetic sequence from a donor plasmid or organism to produce ends of the DNA which may then be readily ligated to another genetic sequence.

In some embodiments, the vector is a non-viral vector, and a physical method or a chemical method is employed for delivery into the somatic cell. Exemplary physical methods include electroporation, gene gun, sonoporation, magnetofection, or hydrodynamic delivery. Exemplary chemical methods include delivery of the recombinant polynucleotide via liposomes such as, cationic lipids or neutral lipids; dendrimers; nanoparticles; or cell-penetrating peptides.

In some embodiments, a fusion effector protein as described herein is inserted into a vector. In some embodiments, the vector comprises one or more promoters, enhancers, ribosome binding sites, RNA splice sites, polyadenylation sites, a replication origin, and/or transcriptional terminator sequences.

In general, plasmids and vectors described herein comprise at least one promoter. In some embodiments, the promoters are constitutive promoters. In other embodiments, the promoters are inducible promoters. In additional embodiments, the promoters are prokaryotic promoters (e.g., drive expression of a gene in a prokaryotic cell). In some embodiments, the promoters are eukaryotic promoters, (e.g., drive expression of a gene in a eukaryotic cell). Exemplary promoters include, but are not limited to, CMV, EF1a, SV40, PGK1, Ubc, human beta actin, CAG, TRE, UAS, Ac5, polyhedron, CaMKIIa, GAL1-10, TEF1, GDS, ADH1, CaMV35S, Ubi, H1, U6, CaMV35S, SV40, CMV, and HSV TK promoter. In some embodiments, the promoter is CMV. In some embodiments, the promoter is EF1a. In some embodiments, the promoter is ubiquitin. In some embodiments, vectors are bicistronic or polycistronic vector (e.g., having or involving two or more loci responsible for generating a protein) having an internal ribosome entry site (IRES) is for translation initiation in a cap-independent manner.

In some embodiments, vectors comprise an enhancer Enhancers are nucleotide sequences that have the effect of enhancing promoter activity. In some embodiments, enhancers augment transcription regardless of the orientation of their sequence. In some embodiments, enhancers activate transcription from a distance of several kilo basepairs. Furthermore, enhancers are located optionally upstream or downstream of a gene region to be transcribed, and/or located within the gene, to activate the transcription. Exemplary enhancers include, but are not limited to, WPRE; CMV enhancers; the R-U5' segment in LTR of HTLV-I (Mol. Cell. Biol., Vol. 8(1), p. 466-472, 1988); SV40 enhancer; the intron sequence between exons 2 and 3 of rabbit β-globin (Proc. Natl. Acad. Sci. USA., Vol. 78(3), p. 1527-31, 1981); and the genome region of human growth hormone (J Immunol., Vol. 155(3), p. 1286-95, 1995).

Pharmaceutical compositions described herein may comprise a salt. In some embodiments, the salt is a sodium salt. In some embodiments, the salt is a potassium salt. In some embodiments, the salt is a magnesium salt. In some embodiments, the salt is NaCl. In some embodiments, the salt is KNO3. In some embodiments, the salt is $Mg^{2+}SO_4^{2-}$.

Non-limiting examples of pharmaceutically acceptable carriers and diluents suitable for the pharmaceutical compositions disclosed herein include buffers (e.g., neutral buffered saline, phosphate buffered saline); carbohydrates (e.g., glucose, mannose, sucrose, dextran, mannitol); polypeptides or amino acids (e.g., glycine); antioxidants; chelating agents (e.g., EDTA, glutathione); adjuvants (e.g., aluminum hydroxide); surfactants (Polysorbate 80, Polysorbate 20, or Pluronic F68); glycerol; sorbitol; mannitol; polyethyleneglycol; and preservatives.

In some embodiments, pharmaceutical compositions are in the form of a solution (e.g., a liquid). The solution may be formulated for injection, e.g., intravenous or subcutaneous injection. In some embodiments, the pH of the solution is about 7, about 7.1, about 7.2, about 7.3, about 7.4, about 7.5, about 7.6, about 7.7, about 7.8, about 7.9, about 8, about 8.1, about 8.2, about 8.3, about 8.4, about 8.5, about 8.6, about 8.7, about 8.8, about 8.9, or about 9. In some embodiments, the pH is 7 to 7.5, 7.5 to 8, 8 to 8.5, 8.5 to 9, or 7 to 8.5. In some embodiments, the pH of the solution is less than 7. In some embodiments, the pH is greater than 7.

In some embodiments, pharmaceutical compositions comprise an: effector protein, fusion effector protein, fusion partner, a guide nucleic acid, or a combination thereof; and a pharmaceutically acceptable carrier or diluent. In some embodiments, pharmaceutical compositions comprise one or more nucleic acids encoding an: effector protein, fusion effector protein, fusion partner, a guide nucleic acid, or a combination thereof; and a pharmaceutically acceptable carrier or diluent. In some embodiments, guide nucleic acid can be a plurality of guide nucleic acids. In some embodiments, pharmaceutical compositions comprise a effector protein and a guide nucleic acid wherein the effector protein comprises a sequence that is at least 65%, at least 70%, at least 75%, at least 80%, at least 85%, at least 90%, at least 95%, at least 97%, or at least 98%, at least 99%, or 100% identical to any one of the sequences of 1-45, 202-293, and 728-731 and the guide nucleic acid comprises a nucleotide sequence of any one of the nucleotide sequences of SEQ ID NOS: 624, 628, 630, 634, 638, 641, 643, 645, 646, 630, 641, and 827-929.

XII. Methods of Detecting a Target Nucleic Acid

Provided herein are methods of detecting target nucleic acids. Methods may comprise detecting target nucleic acids with compositions or systems described herein. Methods may comprise detecting a target nucleic acid with systems described herein that comprise a DETECTR assay. Methods may comprise detecting a target nucleic acid in a sample, e.g., a cell lysate, a biological fluid, or environmental sample. Methods may comprise detecting a target nucleic acid in a cell. In some instances, methods of detecting a target nucleic acid in a sample or cell comprises contacting the sample or cell with a D2S effector protein or a multimeric complex thereof, a guide nucleic acid, wherein at least a portion of the guide nucleic acid is complementary to at least a portion of the target nucleic acid, and a reporter nucleic acid that is cleaved in the presence of the D2S effector protein, the guide nucleic acid, and the target nucleic acid, and detecting a signal produced by cleavage of the reporter nucleic acid, thereby detecting the target nucleic acid in the sample. In some instances, methods result in transcollateral cleavage of the reporter nucleic acid. In some instances, methods result in cis cleavage of the reporter nucleic acid.

In some instances, the effector protein comprises an amino acid sequence that is at least is at least 70%, at least 75%, at least 80%, at least 85%, at least 90%, at least 92%, at least 95%, at least 97%, at least 98%, at least 99%, or 100% identical to any one of SEQ ID NOs: 1-45. In some instances, the effector protein comprises an amino acid sequence that is at least is at least 70%, at least 75%, at least 80%, at least 85%, at least 90%, at least 92%, at least 95%, at least 97%, at least 98%, at least 99%, or 100% identical to any one of SEQ ID NOs: 1-45, 202-293, or 728-731. In some instances, the amino acid sequence of the effector protein is at least 70%, at least 75%, at least 80%, at least 85%, at least 90%, at least 92%, at least 95%, at least 97%, at least 98%, at least 99%, or 100% identical to any one of SEQ ID NOs: 1-45. In some instances, the amino acid sequence of the effector protein is at least 70%, at least 75%, at least 80%, at least 85%, at least 90%, at least 92%, at least 95%, at least 97%, at least 98%, at least 99%, or 100% identical to any one of SEQ ID NOs: 1-45, 202-293, or 728-731. In some instances, the nucleobase sequence of the guide is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide comprises a crRNA nucleobase sequence that is at least 70%, at least 75%, at least 80%, at least 85%, at least 90%, at least 92%, at least 95%, or 100% identical to any one of SEQ ID NOs: 46-90. In some instances, the guide comprises a tracrRNA nucleobase sequence that is at least 70%, at least 75%, at least 80%, at least 85%, at least 90%, at least 92%, at least 95%, or 100% identical to any one of SEQ ID NOs: 91-148.

Methods may comprise contacting the sample to a complex comprising a guide nucleic acid comprising a segment that is reverse complementary to a segment of the target nucleic acid and a D2S effector protein that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample.

Methods may comprise contacting the sample comprising the target nucleic acid with a guide nucleic acid targeting a target nucleic acid segment, a D2S effector protein capable of being activated when complexed with the guide nucleic acid and the target nucleic acid segment, a single stranded nucleic acid of a reporter comprising a detection moiety, wherein the nucleic acid of a reporter is capable of being cleaved by the activated D2S effector protein, thereby generating a first detectable signal, cleaving the single stranded nucleic acid of a reporter using the D2S effector protein that cleaves as measured by a change in color, and measuring the first detectable signal on the support medium.

Methods may comprise contacting the sample or cell with a D2S effector protein or a multimeric complex thereof and a guide nucleic acid at a temperature of at least about 25° C., at least about 30° C., at least about 35° C., at least about 40° C., at least about 50° C., or at least about 65° C. In some instances, the temperature is not greater than 80° C. In some instances, the temperature is about 25° C., about 30° C., about 35° C., about 40° C., about 45° C., about 50° C., about 55° C., about 60° C., about 65° C., or about 70° C. In some instances, the temperature is about 25° C. to about 45° C., about 35° C. to about 55° C., or about 55° C. to about 65° C.

Methods may comprise cleaving a strand of a single-stranded target nucleic acid with a D2S or a multimeric complex thereof, as assessed with an in vitro cis-cleavage assay. A cleavage assay can comprise an assay designed to visualize, quantitate or identify cleavage of a nucleic acid. In some cases, the cleavage activity may be cis-cleavage activity. In some cases, the cleavage activity may be trans-cleavage activity. An example of such an assay (an in vitro cis-cleavage assay). An example of such an assay may follow a procedure comprising: (i) providing equimolar (e.g., 500 nM) amounts of a D2S effector protein comprising at least 70% sequence identity to any one of SEQ ID NOs: 1-45 and a guide nucleic acid at 40 to 45° C. for 5 minutes in pH 7.5 Tris-HCl buffer, 40 mM NaCl, 2 mM Ca(NO3)2, 1 mM BME, thereby forming a ribonucleoprotein complex comprising a dimer of the D2S effector protein and the guide nucleic acid; (ii) adding linear dsDNA comprising a nucleic acid sequence targeted by the guide nucleic acid and adjacent to a PAM comprising the sequence 5'-TTTA-3'; (iii) incubating the mixture at 45° C. for 20 minutes, thereby enabling cleavage of the plasmid; (iv) quenching the reaction with EDTA and a protease; and (v) analyzing the reaction products (e.g., viewing the cleaved and uncleaved linear dsDNA with gel electrophoresis).

In some embodiments, cleave, cleaving, and cleavage, with reference to a nucleic acid molecule or nuclease activity of an effector protein, comprise the hydrolysis of a phosphodiester bond of a nucleic acid molecule that results in breakage of that bond. The result of this breakage can be a nick (hydrolysis of a single phosphodiester bond on one side of a double-stranded molecule), single strand break (hydrolysis of a single phosphodiester bond on a single-stranded molecule) or double strand break (hydrolysis of two phosphodiester bonds on both sides of a double-stranded molecule) depending upon whether the nucleic acid molecule is single-stranded (e.g., ssDNA or ssRNA) or double-stranded (e.g., dsDNA) and the type of nuclease activity being catalyzed by the effector protein.

In some cases, there is a threshold of detection for methods of detecting target nucleic acids. In some instances, methods are not capable of detecting target nucleic acids that are present in a sample or solution at a concentration less than or equal to 10 nM. The term "threshold of detection" is used herein to describe the minimal amount of target nucleic acid that must be present in a sample in order for detection to occur. For example, when a threshold of detection is 10 nM, then a signal can be detected when a target nucleic acid is present in the sample at a concentration of 10 nM or more. In some cases, the threshold of detection is less than or equal to 5 nM, 1 nM, 0.5 nM, 0.1 nM, 0.05 nM, 0.01 nM, 0.005 nM, 0.001 nM, 0.0005 nM, 0.0001 nM, 0.00005 nM, 0.00001 nM, 10 pM, 1 pM, 500 fM, 250 fM, 100 fM, 50 fM, 10 fM, 5 fM, 1 fM, 500 attomole (aM), 100 aM, 50 aM, 10 aM, or 1 aM. In some cases, the threshold of detection is in a range of from 1 aM to 1 nM, 1 aM to 500 pM, 1 aM to 200 pM, 1 aM to 100 pM, 1 aM to 10 pM, 1 aM to 1 pM, 1 aM to 500 fM, 1 aM to 100 fM, 1 aM to 1 fM, 1 aM to 500 aM, 1 aM to 100 aM, 1 aM to 50 aM, 1 aM to 10 aM, 10 aM to 1 nM, 10 aM to 500 pM, 10 aM to 200 pM, 10 aM to 100 pM, 10 aM to 10 pM, 10 aM to 1 pM, 10 aM to 500 fM, 10 aM to 100 fM, 10 aM to 1 fM, 10 aM to 500 aM, 10 aM to 100 aM, 10 aM to 50 aM, 100 aM to 1 nM, 100 aM to 500 pM, 100 pM to 200 pM, 100 aM to 100 pM, 100 aM to 10 pM, 100 aM to 1 pM, 100 aM to 500 fM, 100 aM to 100 fM, 100 aM to 1 fM, 100 aM to 500 aM, 500 aM to 1 nM, 500 aM to 500 pM, 500 aM to 200 pM, 500 aM to 100 pM, 500 aM to 10 pM, 500 aM to 1 pM, 500 aM to 500 fM, 500 aM to 100 fM, 500 aM to 1 fM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, 1 pM to 1 nM, 1 pM to 500 pM, 1 pM to 200 pM, 1 pM to 100 pM, or 1 pM to 10 pM. In some cases, the threshold of detection in a range of from 800 fM to 100 pM, 1 pM to 10 pM, 10 fM to 500 fM, 10 fM to 50 fM, 50 fM to 100 fM, 100 fM to 250 fM, or 250 fM to 500 fM. In some cases, the threshold of detection is in a range of from 2 aM to 100 pM, from 20 aM to 50 pM, from 50 aM to 20 pM, from 200 aM to 5 pM, or from 500 aM to 2 pM. In some cases, the minimum concentration at which a target nucleic acid is detected in a sample is in a range of from 1 aM to 1 nM, 10 aM to 1 nM, 100 aM to 1 nM, 500 aM to 1 nM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, 1 pM to 1 nM, 1 pM to 500 pM, from 1 pM to 200 pM, 1 pM to 100 pM, or 1 pM to 10 pM. In some cases, the minimum concentration at which a target nucleic acid is detected in a sample is in a range of from 2 aM to 100 pM, from 20 aM to 50 pM, from 50 aM to 20 pM, from 200 aM to 5 pM, or from 500 aM to 2 pM. In some cases, the minimum concentration at which a single stranded target nucleic acid can be detected in a sample is in a range of from 1 aM to 100 pM. In some cases, the minimum concentration at which a target nucleic acid can be detected in a sample is in a range of from 1 fM to 100 pM. In some cases, the minimum concentration at which a single stranded target nucleic acid can be detected in a sample is in a range of from 10 fM to 100 pM. In some cases, the minimum concentration at which a single stranded target nucleic acid can be detected in a sample is in a range of from 800 fM to 100 pM. In some cases, the minimum concentration at which a single stranded target nucleic acid can be detected in a sample is in a range of from 1 pM to 10 pM. In some cases, the devices, systems, fluidic devices, kits, and methods described herein detect a target single-stranded nucleic acid in a sample comprising a plurality of nucleic acids such as a plurality of non-target nucleic acids, where the target single-stranded nucleic acid is present at a concentration as low as 1 aM, 10 aM, 100 aM, 500 aM, 1 fM, 10 fM, 500 fM, 800 fM, 1 pM, 10 pM, 100 pM, or 1 pM.

In some instances, the target nucleic acid is present in a cleavage reaction at a concentration of about 10 nM, about 20 nM, about 30 nM, about 40 nM, about 50 nM, about 60 nM, about 70 nM, about 80 nM, about 90 nM, about 100 nM, about 200 nM, about 300 nM, about 400 nM, about 500 nM, about 600 nM, about 700 nM, about 800 nM, about 900 nM, about 1 µM, about 10 µM, or about 100 µM. In some instances, the target nucleic acid is present in the cleavage reaction at a concentration of from 10 nM to 20 nM, from 20 nM to 30 nM, from 30 nM to 40 nM, from 40 nM to 50 nM, from 50 nM to 60 nM, from 60 nM to 70 nM, from 70 nM to 80 nM, from 80 nM to 90 nM, from 90 nM to 100 nM, from 100 nM to 200 nM, from 200 nM to 300 nM, from 300 nM to 400 nM, from 400 nM to 500 nM, from 500 nM to 600 nM, from 600 nM to 700 nM, from 700 nM to 800 nM, from 800 nM to 900 nM, from 900 nM to 1 µM, from 1 µM to 10 µM, from 10 µM to 100 µM, from 10 nM to 100 nM, from 10 nM to 1 µM, from 10 nM to 10 µM, from 10 nM to 100 µM, from 100 nM to 1 µM, from 100 nM to 10 µM, from 100 nM to 100 µM, or from 1 µM to 100 µM. In some instances, the target nucleic acid is present in the cleavage reaction at a concentration of from 20 nM to 50 µM, from 50 nM to 20 µM, or from 200 nM to 5 µM.

In some cases, methods detect a target nucleic acid in less than 60 minutes. In some cases, methods detect a target nucleic acid in less than about 120 minutes, less than about 110 minutes, less than about 100 minutes, less than about 90 minutes, less than about 80 minutes, less than about 70 minutes, less than about 60 minutes, less than about 55 minutes, less than about 50 minutes, less than about 45 minutes, less than about 40 minutes, less than about 35 minutes, less than about 30 minutes, less than about 25 minutes, less than about 20 minutes, less than about 15 minutes, less than about 10 minutes, less than about 5 minutes, less than about 4 minutes, less than about 3 minutes, less than about 2 minutes, or less than about 1 minute.

In some cases, methods require at least about 120 minutes, at least about 110 minutes, at least about 100 minutes, at least about 90 minutes, at least about 80 minutes, at least about 70 minutes, at least about 60 minutes, at least about 55 minutes, at least about 50 minutes, at least about 45 minutes, at least about 40 minutes, at least about 35 minutes, at least about 30 minutes, at least about 25 minutes, at least about 20 minutes, at least about 15 minutes, at least about 10 minutes, or at least about 5 minutes to detect a target nucleic acid. In some cases, the sample is contacted with the reagents for from 5 minutes to 120 minutes, from 5 minutes to 100 minutes, from 10 minutes to 90 minutes, from 15 minutes to 45 minutes, or from 20 minutes to 35 minutes.

In some cases, methods of detecting are performed in less than 10 hours, less than 9 hours, less than 8 hours, less than 7 hours, less than 6 hours, less than 5 hours, less than 4 hours, less than 3 hours, less than 2 hours, less than 1 hour, less than 50 minutes, less than 45 minutes, less than 40 minutes, less than 35 minutes, less than 30 minutes, less than 25 minutes, less than 20 minutes, less than 15 minutes, less than 10 minutes, less than 9 minutes, less than 8 minutes, less than 7 minutes, less than 6 minutes, or less than 5 minutes. In some cases, methods of detecting are performed in about 5 minutes to about 10 hours, about 10 minutes to about 8 hours, about 15 minutes to about 6 hours, about 20 minutes to about 5 hours, about 30 minutes to about 2 hours, or about 45 minutes to about 1 hour.

Methods may comprise detecting a detectable signal within 5 minutes of contacting the sample and/or the target nucleic acid with the guide nucleic acid and/or the D2S effector protein. In some cases, detecting occurs within 1, 2, 3, 4, 5, 6, 7, 8, 9, 10, 11, 12, 13, 14, 15, 20, 25, 30, 35, 40, 45, 50, 55, 60, 70, 80, 90, 100, 110, or 120 minutes of contacting the target nucleic acid. In some instances, detecting occurs within 1 to 120, 5 to 100, 10 to 90, 15 to 80, 20 to 60, or 30 to 45 minutes of contacting the target nucleic acid.

Amplification of a Target Nucleic Acid

Methods may comprise amplifying a target nucleic acid for detection using any of the compositions or systems described herein. Amplifying may comprise changing the temperature of the amplification reaction, also known as thermal amplification (e.g., PCR). Amplifying may be performed at essentially one temperature, also known as isothermal amplification. Amplifying may improve at least one of sensitivity, specificity, or accuracy of the detection of the target nucleic acid.

Amplifying may comprise subjecting a target nucleic acid to an amplification reaction selected from transcription mediated amplification (TMA), helicase dependent amplification (HDA), or circular helicase dependent amplification (cHDA), strand displacement amplification (SDA), recombinase polymerase amplification (RPA), loop mediated amplification (LAMP), exponential amplification reaction (EXPAR), rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), and improved multiple displacement amplification (IMDA).

In some instances, amplification of the target nucleic acid comprises modifying the sequence of the target nucleic acid. For example, amplification may be used to insert a PAM sequence into a target nucleic acid that lacks a PAM sequence. In some cases, amplification may be used to increase the homogeneity of a target nucleic acid in a sample. For example, amplification may be used to remove a nucleic acid variation that is not of interest in the target nucleic acid sequence.

Amplifying may take 1, 2, 3, 4, 5, 6, 7, 8, 9, 10, 11, 12, 13, 14, 15, 16, 17, 18, 19, 20, 25, 30, 40, 50, or 60 minutes. Amplifying may be performed at a temperature of around 20-45° C. Amplifying may be performed at a temperature of less than about 20° C., less than about 25° C., less than about 30° C., 35° C., less than about 37° C., less than about 40° C., or less than about 45° C. The nucleic acid amplification reaction may be performed at a temperature of at least about 20° C., at least about 25° C., at least about 30° C., at least about 35° C., at least about 37° C., at least about 40° C., or at least about 45° C.

Certain Methods of Detection

An illustrative method for detecting a target nucleic acid molecule in a sample comprises contacting the sample comprising the target nucleic acid molecule with (i) a D2S effector protein comprising at least 75% sequence identity to a sequence selected from the group consisting of SEQ ID NOs: 1-45, 202-293, or 728-731; (ii) an engineered guide nucleic acid comprising a region that binds to the effector protein and an additional region that binds to the target nucleic acid; and (iii) a labeled, single stranded RNA reporter; cleaving the labeled single stranded RNA reporter by the effector protein to release a detectable label; and detecting the target nucleic acid by measuring a signal from the detectable label. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 92%, at least 95%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, or 100% identical to any one of SEQ ID NOs: 91-148.

A further illustrative method for detecting a target nucleic acid molecule in a sample comprises contacting the sample comprising the target nucleic acid molecule with (i) a dimeric protein complex comprising a D2S effector protein comprising at least 75% sequence identity to a sequence selected from the group consisting of SEQ ID NOs: 1-45, 202-293, or 728-731; (ii) an engineered guide nucleic acid comprising a first region that binds to the target nucleic acid; (iii) a nucleic acid comprising a first region that binds to the effector protein and an additional region that hybridizes to second region of the engineered guide nucleic acid; and (iv) a labeled, single stranded RNA reporter; cleaving the labeled single stranded RNA reporter by the effector protein to release a detectable label; and detecting the target nucleic acid by measuring a signal from the detectable label. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 92%, at least 95%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, or 100% identical to any one of SEQ ID NOs: 91-148.

XIII. Methods of Nucleic Acid Editing

Provided herein are methods of editing target nucleic acids. In general, editing refers to modifying the nucleobase sequence of a target nucleic acid. However, compositions and systems disclosed herein may also be capable of making epigenetic modifications of target nucleic acids. D2S effector proteins, multimeric complexes thereof and systems described herein may be used for editing or modifying a target nucleic acid. Editing a target nucleic acid may comprise one or more of cleaving the target nucleic acid, deleting one or more nucleotides of the target nucleic acid, inserting one or more nucleotides into the target nucleic acid, mutating one or more nucleotides of the target nucleic acid, or modifying (e.g., methylating, demethylating, deaminating, or oxidizing) of one or more nucleotides of the target nucleic acid.

Methods of editing may comprise contacting a target nucleic acid with a D2S effector protein and a guide nucleic acid, wherein the effector protein comprises an amino acid sequence that is at least 70%, at least 75%, at least 80%, at least 85%, at least 90%, at least 95%, at least 97%, or at least 98%, at least 99%, or 100% identical to any one of SEQ ID NOs: 1-45, 202-293, or 728-731. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 92%, at least 95%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, or 100% identical to any one of SEQ ID NOs: 91-148.

Editing may introduce a mutation (e.g., point mutations, deletions) in a target nucleic acid relative to a corresponding wildtype nucleobase sequence. Editing may remove or correct a disease-causing mutation in a nucleic acid sequence to produce a corresponding wildtype nucleobase sequence. Editing may remove/correct point mutations, deletions, null mutations, or tissue-specific mutations in a target nucleic acid. Editing may be used to generate gene knock-out, gene knock-in, gene editing, gene tagging, or a combination thereof. Methods of the disclosure may be targeted to any locus in a genome of a cell.

Editing may comprise single stranded cleavage, double stranded cleavage, donor nucleic acid insertion, epigenetic modification (e.g., methylation, demethylation, acetylation, or deacetylation), or a combination thereof. In some instances, cleavage (single-stranded or double-stranded) is site-specific, meaning cleavage occurs at a specific site in the target nucleic acid, often within the region of the target nucleic acid that hybridizes with the guide nucleic acid spacer region. In some cases, the D2S effector proteins introduce a single-stranded break in a target nucleic acid to produce a cleaved nucleic acid. In some cases, the effector protein is capable of introducing a break in a single stranded RNA (ssRNA). The D2S effector protein may be coupled to a guide nucleic acid that targets a particular region of interest in the ssRNA. In some instances, the target nucleic acid, and the resulting cleaved nucleic acid is contacted with a nucleic acid for homologous recombination (e.g., homology directed repair (HDR)) or non-homologous end joining (NHEJ). In some cases, a double-stranded break in the target nucleic acid may be repaired (e.g., by NHEJ or HDR) without insertion of a donor template, such that the repair results in an indel in the target nucleic acid at or near the site of the double-stranded break.

In some instances, the D2S effector protein is fused to a chromatin-modifying enzyme. In some cases, the fusion protein chemically modifies the target nucleic acid, for example by methylating, demethylating, or acetylating the target nucleic acid in a sequence specific or non-specific manner.

Methods may comprise use of two or more D2S effector proteins. An illustrative method for introducing a break in a target nucleic acid comprises contacting the target nucleic acid with: (a) a first engineered guide nucleic acid comprising a region that binds to a first D2S effector protein, wherein the effector protein comprises at least 75% sequence identity to a sequence selected from the group consisting of SEQ ID NOs: 1-45, 202-293, or 728-731; and (b) a second engineered guide nucleic acid comprising a region that binds to a second D2S effector protein, wherein the effector protein comprises at least 75% sequence identity to a sequence selected from the group consisting of SEQ ID NOs: 1-45, 202-293, or 728-731, wherein the first engineered guide nucleic acid comprises an additional region that binds to the target nucleic acid and wherein the second engineered guide nucleic acid comprises an additional region that binds to the target nucleic acid. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 92%, at least 95%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, or 100% identical to any one of SEQ ID NOs: 91-148.

In some instances, editing a target nucleic acid comprises genome editing. Genome editing may comprise modifying a genome, chromosome, plasmid, or other genetic material of a cell or organism. In some instances, the genome, chromosome, plasmid, or other genetic material of the cell or organism is modified in vivo. In some instances, the genome, chromosome, plasmid, or other genetic material of the cell or organism is modified in a cell. In some instances, the genome, chromosome, plasmid, or other genetic material of the cell or organism is modified in vitro. For example, a plasmid may be modified in vitro using a composition described herein and introduced into a cell or organism. In some instances, modifying a target nucleic acid may comprise deleting a sequence from a target nucleic acid. For example, a mutated sequence or a sequence associated with a disease may be removed from a target nucleic acid. In some instances, modifying a target nucleic acid may comprise replacing a sequence in a target nucleic acid with a second sequence. For example, a mutated sequence or a sequence associated with a disease may be replaced with a second sequence lacking the mutation or that is not associated with the disease. In some instances, modifying a target nucleic acid may comprise introducing a sequence into a target nucleic acid. For example, a beneficial sequence or a sequence that may reduce or eliminate a disease may be inserted into the target nucleic acid.

In some instances, methods comprise inserting a donor nucleic acid into a cleaved target nucleic acid. The donor nucleic acid may be inserted at a specified (e.g., effector protein targeted) point within the target nucleic acid. In some instances, methods comprise contacting a target nucleic acid with a D2S effector protein comprising an amino acid sequence that is at least 70%, at least 75%, at least 80%, at least 85%, at least 90%, at least 95%, at least 97%, at least 98%, at least 99%, or 100% identical to any one of SEQ ID NOs: 1-45, 202-293, or 728-731, thereby introducing a single-stranded break in the target nucleic acid; contacting the target nucleic acid with a second effector protein, optionally comprising an amino acid sequence that is at least 70%, at least 75%, at least 80%, at least 85%, at least 90%, at least 95%, at least 97%, at least 98%, or at least 99% identical to any one of SEQ ID NOs: 11-45, 202-293, or 728-731, to generate a second cleavage site in the target nucleic acid, ligating the regions flanking the first and second cleavage site, optionally through NHEJ or single-strand annealing, thereby resulting in the excision of a portion of the target nucleic acid between the first and second cleavage sites from the target nucleic acid; and contacting the target nucleic acid with a donor nucleic acid for homologous recombination, optionally via HDR or NHEJ, thereby introducing a new sequence into the target nucleic acid (e.g., at a cleavage site or in between two cleavage sites).

In some cases, methods comprise editing a target nucleic acid with two or more effector proteins. Editing a target nucleic acid may comprise introducing a two or more single-stranded breaks in a target nucleic acid. In some instances, a break may be introduced by contacting a target nucleic acid with an effector protein and a guide nucleic acid. The guide nucleic acid may bind to the effector protein, e.g., a D2S effector protein, and hybridize to a region of the target nucleic acid, thereby recruiting the effector protein to the region of the target nucleic acid. Binding of the effector protein to the guide nucleic acid and the region of the target nucleic acid may activate the effector protein, and the effector protein may introduce a break (e.g., a single stranded break) in the region of the target nucleic acid. In some instances, modifying a target nucleic acid may comprise introducing a first break in a first region of the target nucleic acid and a second break in a second region of the target nucleic acid. For example, modifying a target nucleic acid may comprise contacting a target nucleic acid with a first guide nucleic acid that binds to a first effector protein and hybridizes to a first region of the target nucleic acid and a second guide nucleic acid that binds to a second programmable nickase and hybridizes to a second region of the target nucleic acid. The first effector protein, e.g., a D2S effector protein, may introduce a first break in a first strand at the first region of the target nucleic acid, and the second effector protein may introduce a second break in a second strand at the second region of the target nucleic acid. In some instances, a segment of the target nucleic acid between the first break and the second break may be removed, thereby modifying the target nucleic acid. In some instances, a segment of the target nucleic acid between the first break and the second break may be replaced (e.g., with donor nucleic acid), thereby modifying the target nucleic acid. In some instances, the D2S effector protein comprises an amino acid sequence that is at least 70%, at least 75%, at least 80%, at least 85%, at least 90%, at least 95%, at least 97%, at least 98%, at least 99%, or 100% identical to any one of SEQ ID NOs: 1-45, 202-293, or 728-731. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 95%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, or 100% identical to any one of SEQ ID NOs: 91-148.

Base editing is a genome editing method that directly generates precise nucleotide changes in genomic DNA or RNA without generating DSBs, requiring a DNA donor template, or relying on cellular homology-directed repair (HDR). In general, base editors comprise a base editing enzyme (e.g., a deaminase) fused to a catalytically inactive CRISPR-associated (Cas) protein, wherein the catalytically inactive CRISPR-associated (Cas) protein is coupled to a guide nucleic acid that imparts activity or sequence selectivity to the base editor. In some embodiments, the effector protein is a catalytically inactive effector protein. In some embodiments, the effector protein comprises an amino acid sequence that is at least 75%, at least 80%, at least 85%, at least 90%, at least 95%, at least 98%, at least 99%, or 100% identical to any one of SEQ ID NOs: 728, 729, 730, or 731.

In some embodiments, the amino acid sequence of the effector protein is modified relative to a naturally-occurring effector protein. Such modified effector proteins may be referred to as an engineered effector protein. In some embodiments, the engineered effector protein has been modified to inactivate a catalytically active nuclease domain (e.g., a RuvC domain, HNH domain) of the naturally-occurring effector protein. In some embodiments, the engineered effector protein has been modified to reduce the activity of a catalytically active nuclease domain of the naturally-occurring effector protein. The engineered effector protein may have less than 90%, less than 80%, less than 70%, less than 60%, less than 50%, less than 40%, less than 30%, less than 20%, less than 10%, less than 5%, or less than 1% of the nucleic acid-cleaving activity as compared to the naturally-occurring effector protein as compared in a cleavage assay. In some embodiments, the effector protein has been modified to comprise at least 1, at least 2, at least 3, at least 4, or at least 5 amino acid modifications relative to the non-modified version (e.g. wild-type of naturally occurring version) of the effector protein. The amino acid modification(s) may comprise a deletion, insertion, or substitution of an amino acid.

In some cases, editing is achieved by fusing an effector protein, e.g., a D2S effector protein, to a heterologous sequence. The heterologous sequence may be a suitable fusion partner, e.g., a protein that provides recombinase activity by acting on the target nucleic acid sequence. In some instances, the fusion protein comprises a D2S effector protein fused to a heterologous sequence by a linker. The heterologous sequence or fusion partner may be a base editing domain. The base editing domain may be an ADAR1/2 or any functional variant thereof. The heterologous sequence or fusion partner may be fused to the C-terminus, N-terminus, or an internal portion (e.g., a portion other than the N- or C-terminus) of the D2S effector protein. The heterologous sequence or fusion partner may be fused to the D2S effector protein by a linker. A linker may be a peptide linker or a non-peptide linker. In some instances, the linker is an XTEN linker. In some instances, the linker comprises one or more repeats a tri-peptide GGS (SEQ ID NO: 179). In some instances, the linker is from 1 to 100 amino acids in length. In some instances, the linker is more 100 amino acids in length. In some instances, the linker is from 10 to 27 amino acids in length. A non-peptide linker may be a polyethylene glycol (PEG), polypropylene glycol (PPG), co-poly(ethylene/propylene) glycol, polyoxyethylene (POE), polyurethane, polyphosphazene, polysaccharides, dextran, polyvinyl alcohol, polyvinylpyrrolidones, polyvinyl ethyl ether, polyacrylamide, polyacrylate, polycyanoacrylates, lipid polymers, chitins, hyaluronic acid, heparin, or an alkyl linker.

In some embodiments, heterologous comprises a nucleotide or polypeptide sequence that is not found in a native nucleic acid or protein, respectively. In some embodiments, fusion proteins comprise an effector protein and a fusion partner protein, wherein the fusion partner protein is heterologous to an effector protein. These fusion proteins can comprise a heterologous protein. A protein that is heterologous to the effector protein is a protein that is not covalently linked via an amide bond to the effector protein in nature. In some embodiments, a heterologous protein is not encoded by a species that encodes the effector protein.

Described herein are methods for editing or detecting a target nucleic acid. In some embodiments, the target nucleic acid comprises a portion or a specific region of a nucleic acid from a genomic locus, any DNA amplicon of, a reverse transcribed mRNA, or a cDNA from one or more genes selected from AAVS1, ABCA4, ABCB11, ABCC8, ABCD1, ACAD9, ACADM, ACADVL, ACAT1, ACOX1, ACSF3, ADA, ADAMTS2, ADGRG1, AGA, AGL, AGPS, AGXT, AHI1, AIRE, ALDH3A2, ALDOB, ALG6, ALK, ALKBH5, ALMS1, ALPL, AMRC9, AMT, ANGPTL3, APC, Apo(a), APOCIII, APOEε4, APOL1, APP, AQP2, AR, ARFRP1, ARG1, ARL13B, ARL6, ARSA, ARSB, ASL, ASNS, ASPA, ASS1, ATM, ATP6V1B1, ATP7A, ATP7B, ATRX, ATXN1, ATXN10, ATXN2, ATXN3, ATXN7, ATXN8OS, AXIN1, AXIN2, B2M, BACE-1, BAK1, BAP1, BARD1, BAX2, BBS1, BBS10, BBS12, BBS2, BCKDHA, BCKDHB, BCL2L2, BCS1L, BEST1, Betaglobin gene, BLM, BMPR1A, BRAFV600E, BRCA1, BRCA2, BRIP1, BSND, C282Y, C9orf72, CA4, CACNA1A, CAPN3, CASR, CBS, CC2D2A, CCR5, CDC73, CDH1, CDH23, CDK11, CDK4, CDKN1B, CDKN1C, CDKN2A, CEBPA, CEP290, CERKL, CFTR, CHCHD10, CHEK2, CHM, CHRNE, CIITA, CLN3, CLN5, CLN6, CLN8, CLRN1, CLTA, CNBP, CNGB1, CNGB3, COL1A1, COL1A2, COL27A1, COL4A3, COL4A4, COL4A5, COL7A1, CPS1, CPT1A, CPT2, CRB1, CRX, CTNNA1, CTNNB1, CTNND2, CTNS, CTSK, CYBA, CYBB, CYP11B1, CYP11B2, CYP17A1, CYP19A1, CYP27A1, DBT, DCLRE1C, DERL2, DFNA36, DFNB31, DGAT2, DHCR7, DHDDS, DICER1, DIS3L2, DLD, DMD, DMPK, DNAH5, DNAI1, DNAI2, DNM2, DNMT1, DYSF, EDA, EDN3, EDNRB, EGFR, EIF2B5, EMC2, EMC3, EMD, EMX1, EPCAM, ERCC6, ERCC8, ESCO2, ETFA, ETFDH, ETHE1, EVC, EVC2, EYS, F5, F9, FactorB, FactorXI, FAH, FAM161A, FANCA, FANCB, FANCC, FANCD1, FANCD2, FANCE, FANCF, FANCG, FANCI, FANCJ, FANCL, FANCM, FANCN, FANCP, FANCS, FBN1, FGF14, FGFR2, FGFR3, FH, FHL1, FKRP, FKTN, FLCN, FMR1, FOXP3, FSCN2, FUS, FUT8, FVIII, FXII, FXN, G6PC, GAA, GALC, GALK1, GALT, GAMT, GATA2, GBA, GBE1, GCDH, GCGR, GDNF, GFAP, GFM1, GHR, GJB1, GJB2, GLA, GLB1, GLDC, GLE1, GNE, GNPTAB, GNPTG, GNS, GPC3, GPR98, GREM1, GRHPR, GRIN2B, H2AX, HADHA, HAX1, HBA1, HBA2, HBB, HEXA, HEXB, HGSNAT, HLCS, HMGCL, HOGA1, HOXB13, HPRPF3, HPRT1, HPS1, HPS3, HRAS, HSD17B4, HSD3B2, HTT, HYAL1, HYLS1, IDS, IDUA, IFITM5, IKBKAP, IL2RG, IMPDH1, INPP5E, IRF4, ITPR1, IVD, JAG1, KCNC3, KCND3, KCNJ11, KLHL7, KRAS, LAMA2, LAMA3, LAMB3, LAMC2, LCA5, LDLR, LDLRAP1, LHX3, LIFR, LIPA, LMNA, LOXHD1, LPL, LRAT, LRP6, LRPPRC, LRRK2, MAN2B1, MAPT, MAX, MCOLN1, MECP2, MED17, MEFV, MEN1, MERTK, MESP2, MET, METex14, MFN2, MFSD8, MITF, MKS1, MLC1, MLH1, MLH3, MMAA, MMAB, MMACHC, MMADHC, MMD, MPI, MPL, MPV17, MSH2, MSH3, MSH6, MTHFR, MTM1, MTRR, MTTP, MUT, MUTYH, MYO7A, NAGLU, NAGS, NBN, NDRG1, NDUFAF5, NDUFS6, NEB, NF1, NF2, NOTCH2, NPC1, NPC2, NPHP1, NPHS1, NPHS2, NR2E3, NTHL1, NTRK, NTRK1, OAT, OCT4, OFD1, OPA3, OTC, PAH, PALB2, PAQR8, PAX3, PC, PCCA, PCCB, PCDH15, PCSK9, PD1, PDCD1, PDE6B, PDGFRA, PDHA1, PDHB, PEX1, PEX10, PEX12, PEX13, PEX14, PEX16, PEX19, PEX2, PEX26, PEX3, PEX5, PEX6, PEX7, PFKM, PHGDH, PHOX2B, PKD1, PKD2, PKHD1, PKK, PLEKHG4, PMM2, PMP22, PMS1, PMS2, PNPLA3, POLD1, POLE, POMGNT1, POT1, POU5F1, PPM1A, PPP2R2B, PPT1, PRCD, PRKAR1A, PRKCG, PRNP, PROM1, PROP1, PRPF31, PRPF8, PRPH2, PRPS1, PSAP, PSD95, PSEN1, PSEN2, PTCH1, PTEN, PTS, PUS1, PYGM, RAB23, RAD50, RAD51C, RAD51D, RAG2, RAPSN, RARS2, RB1, RDH12, RECQL4, RET, RHO, RICTOR, RMRP, ROS1, RP1, RP2, RPE65, RPGR, RPGRIP1L, RPL32P3, RS1, RTEL1, RUNX1, SACS, SAMHD1, SCN1A, SCN2A, SDHA, SDHAF2, SDHB, SDHC, SDHD, SEL1L, SEPSECS, SERPING1, SGCA, SGCB, SGCG, SGSH, SIRT1, SLC12A3, SLC12A6, SLC17A5, SLC22A5, SLC25A13, SLC25A15, SLC26A2, SLC26A4, SLC35A3, SLC37A4, SLC39A4, SLC4A11, SLC6A8, SLC7A7, SMAD4, SMARCA4, SMARCAL1, SMARCB1, SMARCE1, SMN1, SMPD1, SNAI2, SNCA, SNRNP200, SOD1, SOX10, SPARA7, SPTBN2, STAR, STAT3, STK11, SUFU, SUMF1, SYNE1, SYNE2, SYS1, TARDBP, TAT, TBK1, TBP, TCIRG1, TCTN3, TECPR2, TERC, TERT, TFR2, TGFBR2, TGM1, TH, TLE3, TMEM127, TMEM138, TMEM216, TMEM43, TMEM67, TMPRSS6, TOP1, TOPORS, TP53, TPP1, IRAC, TRMU, TSFM, TSPAN14, TTBK2, TTC8, TTPA, TTR, TULP1, TYMP, UBE2G2, UBE2J1, UBE3A, USH1C, USH1G, USH2A, VEGF, VHL, VPS13A, VPS13B, VPS35, VPS45, VRK1, VSX2, VWF, WDR19, WNT10A, WS2B, WS2C, XPA, XPC, XPF, YAP1, ZFYVE26, and ZNF423. Further description of editing or detecting a target nucleic acid in the foregoing genes can be found in more detail in Kim et al., "*Enhancement of target specificity of CRISPR-Cas12a by using a chimeric DNA-RNA guide*", Nucleic Acids Res. 2020 Sep. 4; 48(15):8601-8616; Wang et al., "*Specificity profiling of CRISPR system reveals greatly enhanced off-target gene editing*", Scientific Reports volume 10, Article number: 2269 (2020); Tuladhar et al., "*CRISPR-Cas9-based mutagenesis frequently provokes on-target mRNA misregulation*", Nature Communications volume 10, Article number: 4056 (2019); Dong et al., "*Genome-Wide Off-Target Analysis in CRISPR-Cas9 Modified Mice and Their Offspring*", G3, Volume 9, Issue 11, 1 Nov. 2019, Pages 3645-3651; Winter et al., "*Genome-wide CRISPR screen reveals novel host factors required for Staphylococcus aureus α-hemolysin-mediated toxicity*", Scientific Reports volume 6, Article number: 24242 (2016); and Ma et al., "*A CRISPR-Based Screen Identifies Genes Essential for West-Nile-Virus-Induced Cell Death*", Cell Rep. 2015 Jul. 28; 12(4):673-83, which are hereby incorporated by reference in their entirety.

Donor Nucleic Acids

In some embodiments, a donor nucleic acid comprises a nucleic acid that is incorporated into a target nucleic acid or target sequence. In reference to a viral vector, a donor nucleic acid comprises a sequence of nucleotides that will be or has been introduced into a cell following transfection of the viral vector. The donor nucleic acid may be introduced into the cell by any mechanism of the transfecting viral vector, including, but not limited to, integration into the genome of the cell or introduction of an episomal plasmid or viral genome. As another example, when used in reference to the activity of an effector protein, a donor nucleic acid comprises a sequence of nucleotides that will be or has been inserted at the site of cleavage by the effector protein (cleaving (hydrolysis of a phosphodiester bond) of a nucleic acid resulting in a nick or double strand break-nuclease activity). As yet another example, when used in reference to homologous recombination, a donor nucleic acid comprises a sequence of DNA that serves as a template in the process of homologous recombination, which may carry the modification that is to be or has been introduced into the target nucleic acid. By using this donor nucleic acid as a template, the genetic information, including the modification, is copied into the target nucleic acid by way of homologous recombination. In some embodiments, a donor nucleotide, comprises a single nucleotide that is incorporated into a target nucleic acid. A nucleotide is typically inserted at a site of cleavage by an effector protein.

Donor nucleic acids of any suitable size may be integrated into a target nucleic acid or genome. In some instances, the donor polynucleotide integrated into a genome is less than 3, about 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 16, 17, 18, 19, 20, 25, 30, 35, 40, 45, 50, 100, 150, 200, 250, 300, 350, 400, 450, 500 kilobases in length. In some instances, donor nucleic acids are more than 500 kilobases (kb) in length.

The donor nucleic acid may comprise a sequence that is derived from a plant, bacteria, virus or an animal. The animal may be human. The animal may be a non-human animal, such as, by way of non-limiting example, a mouse, rat, hamster, rabbit, pig, bovine, deer, sheep, goat, chicken, cat, dog, ferret, a bird, non-human primate (e.g., marmoset, rhesus monkey). The non-human animal may be a domesticated mammal or an agricultural mammal.

Genetically Modified Cells and Organisms

Methods of editing described herein may be employed to generate a genetically modified cell. The cell may be a eukaryotic cell (e.g., a mammalian cell) or a prokaryotic cell (e.g., an archaeal cell). The cell may be derived from a multicellular organism and cultured as a unicellular entity. The cell may comprise a heritable genetic modification, such that progeny cells derived therefrom comprise the heritable genetic mutation. The cell may be progeny of a genetically modified cell comprising a genetic modification of the genetically modified parent cell. A genetically modified cell may comprise a deletion, insertion, mutation, or non-native sequence relative to a wild-type version of the cell or the organism from which the cell was derived.

Methods may comprise contacting a cell with a nucleic acid (e.g., a plasmid or mRNA) comprising a nucleobase sequence encoding an effector protein, e.g., a D2S effector protein, wherein the effector protein comprises an amino acid sequence that is at least 70%, at least 75%, at least 80%, at least 85%, at least 90%, at least 95%, at least 97%, at least 98%, or at least 99% identical to any one of SEQ ID NOs: 1-45, 202-293, or 728-731.

Methods may comprise contacting cells with a nucleic acid (e.g., a plasmid or mRNA) comprising a nucleobase sequence encoding a guide nucleic acid, a tracrRNA, a crRNA, or any combination thereof. In some instances, the nucleobase sequence of the guide nucleic acid is at least 70%, at least 75%, at least 80%, at least 85%, at least 90%, at least 92%, at least 95%, at least 97%, at least 98%, at least 99%, or 100% identical to any one of SEQ ID NOs: 149-153. In some instances, the guide nucleic acid comprises a crRNA sequence that is at least 70%, at least 75%, at least 80%, at least 85%, at least 90%, at least 92%, at least 95%, at least 97%, at least 98%, at least 99%, or 100% identical to any one of SEQ ID NOs: 46-90. In some instances, the guide nucleic acid comprises a tracrRNA sequence that is at least 70%, at least 75%, at least 80%, at least 85%, at least 90%, at least 92%, at least 95%, at least 97%, at least 98%, at least 99%, or 100% identical to any one of SEQ ID NOs: 91-148. Contacting may comprise electroporation, acoustic poration, optoporation, viral vector-based delivery, iTOP, nanoparticle delivery (e.g., lipid or gold nanoparticle delivery), cell-penetrating peptide (CPP) delivery, DNA nanostructure delivery, or any combination thereof.

Methods may comprise contacting a cell with an effector protein, e.g., a D2S effector protein or a multimeric complex thereof, wherein the effector protein comprises an amino acid sequence that is at least 70%, at least 75%, at least 80%, at least 85%, at least 90%, at least 95%, at least 97%, at least 98%, or at least 99% identical to any one of SEQ ID NOs: 11-45, 202-293, or 728-731. Methods may comprise contacting a cell with an D2S effector effector protein, wherein the amino acid sequence of the D2S effector protein is at least 70%, at least 75%, at least 80%, at least 85%, at least 90%, at least 95%, at least 97%, at least 98%, or at least 99% identical to any one of SEQ ID NOs: 1-45, 202-293, or 728-731.

Methods may comprise cell line engineering (e.g., engineering a cell from a cell line for bioproduction). Cell lines may be used to produce a desired protein. In some instances, target nucleic acids comprise a genomic sequence. In some instances, the cell line is a Chinese hamster ovary cell line (CHO), human embryonic kidney cell line (HEK), cell lines derived from cancer cells, cell lines derived from lymphocytes, and the like. Non-limiting examples of cell lines includes: C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRCS, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr –/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, and YAR.

Non-limiting examples of cells that may be engineered or modified with compositions and methods described herein include immune cells, such as CART, T-cells, B-cells, NK cells, granulocytes, basophils, eosinophils, neutrophils, mast cells, monocytes, macrophages, dendritic cells, antigen-presenting cells (APC), helper T-cells, monocytes, cytotoxic T-cells, suppressor T-cells, or reticulocytes. In some instances, the cell is a hepatocyte. In some instances, the cell is a cardiomyocyte. In some instances, the cell is a myoblast. In some instances, the cell is a bone cell, a muscle cell, a gamete cell, a fat cell or a nerve cell. In some instances, the cell is an epithelial cell, a gland cell, a Paneth cell, a clara cell, exocrine secretory epithelial cell, a hormone-secreting cell, a pituitary cell, a thyroid gland cell, a parathyroid gland cell, a adrenal gland cell, a kidney cell, a liver cell, a pancreatic cell, an alpha cell, a beta cell, a delta cell, a PP cell, or an epsilon cell. In some instances, the cell is a keratinizing epithelial cell. In some instances, the cell is a neuron, a sensory neuron, a motor neuron, an interneuron, a brain neuron. In some instances, the cell is a photoreceptor cell. In some instances, the cell is a nurse cell, an interstitial cell, a barrier cell, an oral cell. In some instances, the cell is a enteroendocrine cell. In some instances, the cell is a Paneth cell, or an exocrine secretory epithelial cell. In some instances, the cell is a keratinocyte a basal cell, a melanocyte, a trichocyte, a intercalated duct cell, a striated duct cell, a duct cell, or an ameloblast. In some cases, the cell is a urinary system cell. In some instances, the cell is an adipocyte, a white fat cell, a brown fat cell, or both. In some instances, the cell is an extracellular matrix cell. In some instances, a cell is a fibroblast, a chondrocyte, an osteoblast, or an osteocyte. In some instances, the cell is a contractile cell, a skeletal muscle cell, a heart muscle cell, or a smooth muscle cell. In some instances, the cell is a sperm cell or an egg cell.

Non-limiting examples of cells that may be engineered or modified with compositions and methods described herein include include plant cells, such as parenchyma, sclerenchyma, collenchyma, xylem, phloem, germline (e.g., pollen). Cells from lycophytes, ferns, gymnosperms, angiosperms, bryophytes, charophytes, chloropytes, rhodophytes, or glaucophytes. Non-limiting examples of cells that may be engineered or modified with compositions and methods described herein include stem cells, such as human stem cells, animal stem cells, stem cells that are not derived from human embryonic stem cells, embryonic stem cells, mesenchymal stem cells, pluripotent stem cells, induced pluripotent stem cells (iPS), somatic stem cells, adult stem cells, hematopoietic stem cells, tissue-specific stem cells.

Methods of the disclosure may be performed in a subject. Compositions of the disclosure may be administered to a subject. A subject may be a human. A subject may be a mammal (e.g., rat, mouse, cow, dog, pig, sheep, horse). A subject may be a vertebrate or an invertebrate. A subject may be a laboratory animal. A subject may be a patient. A subject may be suffering from a disease. A subject may display symptoms of a disease. A subject may not display symptoms of a disease, but still have a disease. A subject may be under medical care of a caregiver (e.g., the subject is hospitalized and is treated by a physician). Methods of the disclosure may be performed in a plant, bacteria, or a fungus.

Methods of the disclosure may be performed in a cell. A cell may be in vitro. A cell may be in vivo. A cell may be ex vivo. A cell may be an isolated cell. A cell may be a cell inside of an organism. A cell may be an organism. A cell may be a cell in a cell culture. A cell may be one of a collection of cells. A cell may be a mammalian cell or derived from a mammalian cell. A cell may be a rodent cell or derived from a rodent cell. A cell may be a human cell or derived from a human cell. A cell may be a prokaryotic cell or derived from a prokaryotic cell. A cell may be a bacterial cell or may be derived from a bacterial cell. A cell may be an archaeal cell or derived from an archaeal cell. A cell may be a eukaryotic cell or derived from a eukaryotic cell. A cell may be a pluripotent stem cell. A cell may be an induced pluripotent stem cell (iPSC). A cell may be a plant cell or derived from a plant cell. A cell may be an animal cell or derived from an animal cell. A cell may be an invertebrate cell or derived from an invertebrate cell. A cell may be a vertebrate cell or derived from a vertebrate cell. A cell may be a microbe cell or derived from a microbe cell. A cell may be a fungi cell or derived from a fungi cell. A cell may be from a specific organ or tissue. A cell may be a T cell. A cell may be a natural killer T cell (NKT). A cell may be a population of cells. In some cases, a cell can be contacted with a DNA donor template.

Methods of the disclosure may be performed in a eukaryotic cell or cell line. In some instances, the eukaryotic cell is a Chinese hamster ovary (CHO) cell. In some instances, the eukaryotic cell is a Human embryonic kidney 293 cells (also referred to as HEK or HEK 293) cell. Non-limiting examples of cell lines that may be used with compositions, systems and methods of the present disclosure include C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, CIR, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRCS, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr –/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, and YAR. Non-limiting examples of other cells that may be used with the disclosure include immune cells, such as CART, T-cells, B-cells, NK cells, granulocytes, basophils, eosinophils, neutrophils, mast cells, monocytes, macrophages, dendritic cells, antigen-presenting cells (APC), or adaptive cells. Non-limiting examples of cells that may be used with this disclosure also include plant cells, such as Parenchyma, sclerenchyma, collenchyma, xylem, phloem, germline (e.g., pollen). Cells from lycophytes, ferns, gymnosperms, angiosperms, bryophytes, charophytes, chloropytes, rhodophytes, or glaucophytes. Non-limiting examples of cells that may be used with this disclosure also include stem cells, such as human stem cells, animal stem cells, stem cells that are not derived from human embryonic stem cells, embryonic stem cells, mesenchymal stem cells, pluripotent stem cells, induced pluripotent stem cells (iPS), somatic stem cells, adult stem cells, hematopoietic stem cells, tissue-specific stem cells.

Agricultural Engineering

Compositions and methods of the disclosure may be used for agricultural engineering. For example, compositions and methods of the disclosure may be used to confer desired traits on a plant. A plant may be engineered for the desired physiological and agronomic characteristic using the present disclosure. In some instances, the target nucleic acid sequence comprises a nucleic acid sequence of a plant. In some instances, the target nucleic acid sequence comprises a genomic nucleic acid sequence of a plant cell. In some instances, the target nucleic acid sequence comprises a nucleic acid sequence of an organelle of a plant cell. In some instances, the target nucleic acid sequence comprises a nucleic acid sequence of a chloroplast of a plant cell.

The plant may be a dicotyledonous plant. Non-limiting examples of orders of dicotyledonous plants include Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales.

The plant may be a monocotyledonous plant. Non-limiting examples of orders of monocotyledonous plants include Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales. A plant may belong to the order, for example, Gymnospermae, Pinales, Ginkgoales, Cycadales, Araucariales, Cupressales and Gnetales.

Non-limiting examples of plants include plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, ferns, clubmosses, hornworts, liverworts, mosses, wheat, maize, rice, millet, barley, tomato, apple, pear, strawberry, orange, acacia, carrot, potato, sugar beets, yam, lettuce, spinach, sunflower, rape seed, *Arabidopsis*, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, *eucalyptus*, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. A plant may include algae.

XIV. Methods of Treatment

Described herein are methods for treating a disease in a subject by modifying a target nucleic acid associated with a gene or expression of a gene related to the disease. In some embodiments, methods comprise administering a composition or cell described herein to a subject. By way of non-limiting example, the disease may be a cancer, an ophthalmological disorder, a neurological disorder, a neurodegenerative disease, a blood disorder, or a metabolic disorder, or a combination thereof. The disease may be an inherited disorder, also referred to as a genetic disorder. The disease may be the result of an infection or associated with an infection. In some embodiments, the disease comprises at least one of: a cancer, an inherited disorder, an ophthalmological disorder, neurological disorder, a blood disorder, a metabolic disorder, a genetic disorder, an infection, or any combination thereof. In some embodiments, the disease or disorder comprises one or more of: achondroplasia, Acromegaly, Alagille Syndrome, Alexander Disease, Alzheimer's disease, amebic dysentery, Amyotrophic lateral sclerosis (ALS), Angelman Syndrome, angioedema, antiphospholipid syndrome, babesiosis, balantidial dysentery, brain or spinal injury, cancer, cardiovascular disease and/or lipodystrophies, centronuclear myopathy, Chagas' disease, Charcot Marie Tooth Disease, CNS trauma, coccidiosis, Cri du chat syndrome, Crouzon syndrome, cystic fibrosis, Dercum disease, diabetes, Dravet Syndrome, Emery-Dreifuss syndrome, encephalitis, epilepsy, Factor V Leiden Thrombophilia, Familial Creutzfeld-Jakob Disease, Familial Mediterranean Fever, Fanconi anemia, fragile X syndrome, Friedreich's ataxia, Gaucher disease, GM2-Gangliosidoses (e.g. Tay Sachs Disease, Sandhoff disease), hearing loss disorders, hemochromatosis, hemophilia, homozygous familial hypercholesterolemia, Huntington's disease, Joubert syndrome, Leber Congenital Amaurosis Type 10, Li-Fraumeni syndrome, Lynch syndrome, Marfan syndrome, MECP2 Duplication syndrome and Rett syndrome, meningitis, methylmalonic acidemia, migraines, myotonic dystrophy, NAFLD/NASH, neurofibromatosis, non-small cell lung cancer, osteogenesis imperfecta, Parkinson's disease, Peutz-Jeghers syndrome, polycystic kidney disease, retinitis pigmentosa, sickle cell anemia, spinocerebellar ataxia, stroke and other hemorrhages, thalassemia, Usher Syndrome, von Hippel-Lindau disease, von Willebrand disease, Waardenburg syndrome, Zellweger syndrome, or any combination thereof.

The compositions and methods described herein may be used to treat, prevent, or inhibit a disease or syndrome in a subject. In some embodiments, a syndrome is a group of symptoms which, taken together, characterize a condition. In some embodiments, the disease is a liver disease, a lung disease, an eye disease, or a muscle disease. Exemplary diseases and syndromes include, but are not limited to: 11-hydroxylase deficiency; 17,20-desmolase deficiency; 17-hydroxylase deficiency; 3-hydroxyisobutyrate aciduria; 3-hydroxysteroid dehydrogenase deficiency; 46,XY gonadal dysgenesis; AAA syndrome; ABCA3 deficiency; ABCC8-associated hyperinsulinism; aceruloplasminemia; acromegaly; achondrogenesis type 2; acral peeling skin syndrome; acrodermatitis enteropathica; adrenocortical micronodular hyperplasia; adrenoleukodystrophies; adrenomyeloneuropathies; Aicardi-Goutieres syndrome; Alagille disease (also called Alagille Syndrome); Alexander Disease, Alpers syndrome; alpha-1 antitrypsin deficiency (AATD); alpha-mannosidosis; Alstrom syndrome; Alzheimer's disease; amebic dysentery; amelogenesis imperfecta; amish type microcephaly; amyotrophic lateral sclerosis (ALS); anaplastic large cell lymphoma; anauxetic dysplasia; androgen insensitivity syndrome; angiopathic thrombosis; antiphospholipid syndrome; Antley-Bixler syndrome; APECED, Apert syndrome, aplasia of lacrimal and salivary glands, argininemia, arrhythmogenic right ventricular dysplasia, Arts syndrome, ARVD2, arylsulfatase deficiency type metachromatic leokodystrophy, ataxia telangiectasia, autoimmune lymphoproliferative syndrome; autoimmune polyglandular syndrome type 1; autosomal dominant anhidrotic ectodermal dysplasia; autosomal dominant deafness; autosomal dominant polycystic kidney disease; autosomal recessive microtia; autosomal recessive renal glucosuria; autosomal visceral heterotaxy; babesiosis; balantidial dysentery; Bardet-Biedl syndrome; Bartter syndrome; basal cell nevus syndrome; Batten disease; benign recurrent intrahepatic cholestasis; beta-mannosidosis; β-thalassemia; Bethlem myopathy; Blackfan-Diamond anemia; bleeding disorder (coagulation); blepharophimosis; Byler disease; C syndrome; CADASIL; calcific aortic stenosis; calcification of joints and arteries; carbamyl phosphate synthetase deficiency; cardiofaciocutaneous syndrome; Carney triad; carnitine palmitoyltransferase deficiencies; cartilage-hair hypoplasia; cblC type of combined methylmalonic aciduria; CD18 deficiency; CD3Z-associated primary T-cell immunodeficiency; CD40L deficiency; CDAGS syndrome; CDG1A; CDG1B; CDG1M; CDG2C; CEDNIK syndrome; central core disease; centronuclear myopathy; cerebral capillary malformation; cerebrooculofacioskeletal syndrome type 4; cerebrooculogacioskeletal syndrome; cerebrotendinous xanthomatosis; Chaga's Disease; Charcot Marie Tooth Disease; cherubism; CHILD syndrome; chronic granulomatous disease; chronic recurrent multifocal osteomyelitis; citrin deficiency; classic hemochromatosis; CNPPB syndrome; cobalamin C disease; Cockayne syndrome; coenzyme Q10 deficiency; Coffin-Lowry syndrome; Cohen syndrome; combined deficiency of coagulation factors V; common variable immune deficiency 3; complement hyperactivation; complete androgen insentivity; cone rod dystrophies; conformational diseases; congenital bile adid synthesis defect type 1; congenital bile adid synthesis defect type 2; congenital defect in bile acid synthesis type; congenital erythropoietic *porphyria*; congenital generalized osteosclerosis; Cornelia de Lange syndrome; coronary heart disease; Cousin syndrome; Cowden disease; COX deficiency; Cri du chat syndrome; Crigler-Najjar disease; Crigler-Najjar syndrome type 1; Crisponi syndrome; Crouzon syndrome; Currarino syndrome; Curth-Macklin type ichthyosis hystrix; cutis laxa; cystic fibrosis; cystinosis; d-2-hydroxyglutaric aciduria; DDP syndrome; Dejerine-Sottas disease; Denys-Drash syndrome; Dercum disease; desmin cardiomyopathy; desmin myopathy; DGUOK-associated mitochondrial DNA depletion; diabetes Type I; diabetes Type II; disorders of glutamate metabolism; distal spinal muscular atrophy type 5; DNA repair diseases; dominant optic atrophy; Doyne honeycomb retinal dystrophy; Dravet Syndrome; Duchenne muscular dystrophy; dyskeratosis congenita; Ehlers-Danlos syndrome type 4; Ehlers-Danlos syndromes; Elejalde disease; Ellis-van Creveld disease; Emery-Dreifuss muscular dystrophies; encephalomyopathic mtDNA depletion syndrome; encephalitis; enzymatic diseases; EPCAM-associated congenital tufting enteropathy; epidermolysis bullosa with pyloric atresia; epilepsy; facioscapulohumeral muscular dystrophy; Factor V Leiden thrombophilia; Faisalabad histiocytosis; familial atypical mycobacteriosis; familial capillary malformation-arteriovenous; Familial Creutzfeld-Jakob disease; familial esophageal achalasia; familial glomuvenous malformation; familial hemophagocytic lymphohistiocytosis; familial mediterranean fever; familial megacalyces; familial schwannomatosis; familial spina bifida; familial splenic asplenia/hypoplasia; familial thrombotic thrombocytopenic purpura; Fanconi disease (Fanconi anemia); Feingold syndrome; FENIB; fibrodysplasia ossificans progressiva; FKTN; Fragile X syndrome; Francois-Neetens fleck corneal dystrophy; Frasier syndrome; Friedreich's ataxia; FTDP-17; Fuchs corneal dystrophy; fucosidosis; G6PD deficiency; galactosialidosis; Galloway syndrome; Gardner syndrome; Gaucher disease; Gitelman syndrome; GLUT1 deficiency; GM2-Gangliosidoses (e.g., Tay Sachs Disease, Sandhoff Disease) glycogen storage disease type 1b; glycogen storage disease type 2; glycogen storage disease type 3; glycogen storage disease type 4; glycogen storage disease type 9a; glycogen storage diseases; GM1-gangliosidosis; Greenberg syndrome; Greig cephalopolysyndactyly syndrome; hair genetic diseases; hairy cell leukemia; HANAC syndrome; harlequin type ichtyosis congenita; HDR syndrome; hearing loss; hemochromatosis type 3; hemochromatosis type 4; hemolytic anemia; hemolytic uremic syndrome; hemophilia A; hemophilia B; hereditary angioedema type 3; hereditary angioedemas; hereditary hemorrhagic telangiectasia; hereditary hypofibrinogenemia; hereditary intraosseous vascular malformation; hereditary leiomyomatosis and renal cell cancer; hereditary neuralgic amyotrophy; hereditary sensory and autonomic neuropathy type; Hermansky-Pudlak disease; HHH syndrome; HHT2; hidrotic ectodermal dysplasia type 1; hidrotic ectodermal dysplasias; histiocytic sarcoma; HNF4A-associated hyperinsulinism; HNPCC; homozygous familial hypercholesterolemia; human immunodeficiency with microcephaly; human papilloma virus (HPV) infection; Huntington's disease; hyper-IgD syndrome; hyperinsulinism-hyperammonemia syndrome; hypercholesterolemia; hypertrophy of the retinal pigment epithelium; hypochondrogenesis; hypohidrotic ectodermal dysplasia; ICF syndrome; idiopathic congenital intestinal pseudo-obstruction; immunodeficiency 13; immunodeficiency 17; immunodeficiency 25; immunodeficiency with hyper-IgM type 1; immunodeficiency with hyper-IgM type 3; immunodeficiency with hyper-IgM type 4; immunodeficiency with hyper-IgM type 5; immunoglobulin alpha deficiency; inborn errors of thyroid metabolism; infantile myofibromatosis; infantile visceral myopathy; infantile X-linked spinal muscular atrophy; intrahepatic cholestasis of pregnancy; IPEX syndrome; IRAK4 deficiency; isolated congenital asplenia; Jeune syndrome; Johanson-Blizzard syndrome; Joubert syndrome; JP-HHT syndrome; juvenile hemochromatosis; juvenile hyalin fibromatosis; juvenile nephronophthisis; Kabuki mask syndrome; Kallmann syndromes; Kartagener syndrome; KCNJ11-associated hyperinsulinism; Kearns-Sayre syndrome; Kostmann disease; Kozlowski type of spondylometaphyseal dysplasia; Krabbe disease; LADD syndrome; late infantile-onset neuronal ceroid lipofuscinosis; LCK deficiency; LDHCP syndrome; Leber Congenital Amaurosis Teyp 10; Legius syndrome; Leigh syndrome; lethal congenital contracture syndrome 2; lethal congenital contracture syndromes; lethal contractural syndrome type 3; lethal neonatal CPT deficiency type 2; lethal osteosclerotic bone dysplasia; leukocyte adhesion deficiency; Li Fraumeni syndrome; LIG4 syndrome; lipodystrophy; lissencephaly type 1; lissencephaly type 3; Loeys-Dietz syndrome; low phospholipid-associated cholelithiasis; Lynch Syndrome; lysinuric protein intolerance; a lysosomal storage disease (e.g., Hunter syndrome, Hurler syndrome); macular dystrophy; Maffucci syndrome; Majeed syndrome; mannose-binding protein deficiency; mantle cell lymphoma; Marfan disease; Marshall syndrome; MASA syndrome; mastocytosis; MCAD deficiency; McCune-Albright syndrome; MCKD2; Meckel syndrome; MECP2 Duplication Syndrome; Meesmann corneal dystrophy; megacystis-microcolon-intestinal hypoperistalsis; megaloblastic anemia type 1; MEHMO; MELAS; Melnick-Needles syndrome; MEN2s; meningitis; Menkes disease; metachromatic leukodystrophies; methymalonic acidemia due to transcobalamin receptor defect; methylmalonic acidurias; methylvalonic aciduria; microcoria-congenital nephrosis syndrome; microvillous atrophy; migraine; mitochondrial neurogastrointestinal encephalomyopathy; monilethrix; monosomy X; mosaic trisomy 9 syndrome; Mowat-Wilson syndrome; mucolipidosis type 2; mucolipidosis type Ma; mucolipidosis type IV; mucopolysaccharidoses; mucopolysaccharidosis type 3A; mucopolysaccharidosis type 3C; mucopolysaccharidosis type 4B; multiminicore disease; multiple acyl-CoA dehydrogenation deficiency; multiple cutaneous and mucosal venous malformations; multiple endocrine neoplasia type 1; multiple sulfatase deficiency; mycosis fungoides; myotonic dystrophy; NAIC; nail-patella syndrome; nemaline myopathies; neonatal diabetes mellitus; neonatal surfactant deficiency; nephronophtisis; Netherton disease; neurofibromatoses; neurofibromatosis type 1; Niemann-Pick disease type A; Niemann-Pick disease type B; Niemann-Pick disease type C; NKX2E; non-alcoholic fatty liver disease (NAFLD); non-alcoholic steatohepatitis (NASH); Noonan syndrome; North American Indian childhood cirrhosis; NROB1 duplication-associated DSD; ocular genetic diseases; oculo-auricular syndrome; OLEDAID; oligomeganephronia; oligomeganephronic renal hypolasia; Ollier disease; Opitz-Kaveggia syndrome; orofaciodigital syndrome type 1; orofaciodigital syndrome type 2; osseous Paget disease; osteogenesis imperfecta; otopalatodigital syndrome type 2; OXPHOS diseases; palmoplantar hyperkeratosis; panlobar nephroblastomatosis; Parkes-Weber syndrome; Parkinson's disease; partial deletion of 21q22.2-q22.3; Pearson syndrome; Pelizaeus-Merzbacher disease; Pendred syndrome; pentalogy of Cantrell; peroxisomal acyl-CoA-oxidase deficiency; Peutz-Jeghers syndrome; Pfeiffer syndrome; Pierson syndrome; pigmented nodular adrenocortical disease; pipecolic acidemia; Pitt-Hopkins syndrome; plasmalogens deficiency; platelet glycoprotein IV deficiency; pleuropulmonary blastoma and cystic nephroma; polycystic kidney disease; polycystic ovarian disease; polycystic lipomembranous osteodysplasia; Pompe disease, including infantile onset Pompe disease (IOPD) and late onset Pompe disease (LOPD); porphyrias; PRKAG2 cardiac syndrome, premature ovarian failure; primary erythermalgia; primary hemochromatoses; primary hyperoxaluria; progressive familial intrahepatic cholestasis; propionic acidemia; protein-losing enteropathy; pyruvate decarboxylase deficiency; RAPADILINO syndrome; renal cystinosis; retinitis pigmentosa; Rett Syndrome; rhabdoid tumor predisposition syndrome; Rieger syndrome; ring chromosome 4; Roberts syndrome; Robinow-Sorauf syndrome; Rothmund-Thomson syndrome; severe combined immunodeficiency disorder (SCID); Saethre-Chotzen syndrome; Sandhoff disease; SC phocomelia syndrome; SCAS; Schinzel phocomelia syndrome; short rib-polydactyly syndrome type 1; short rib-polydactyly syndrome type 4; short-rib polydactyly syndrome type 2; short-rib polydactyly syndrome type 3; Shwachman disease; Shwachman-Diamond disease; sickle cell anemia; Silver-Russell syndrome; Simpson-Golabi-Behmel syndrome; Smith-Lemli-Opitz syndrome; SPG7-associated hereditary spastic paraplegia; spherocytosis; spinocerebellar ataxia; split-hand/foot malformation with long bone deficiencies; spondylocostal dysostosis; sporadic visceral myopathy with inclusion bodies; storage diseases; Stargardt macular dystrophy; STRA6-associated syndrome; stroke; Tay-Sachs disease; thanatophoric dysplasia; thyroid metabolism diseases; Tourette syndrome; transthyretin-associated amyloidosis; trisomy 13; trisomy 22; trisomy 2p syndrome; tuberous sclerosis; tufting enteropathy; urea cycle diseases; Usher Syndrome; Van Den Ende-Gupta syndrome; Van der Woude syndrome; variegated mosaic aneuploidy syndrome; VLCAD deficiency; von Hippel-Lindau disease; von Willebrand disease; Waardenburg syndrome; WAGR syndrome; Walker-Warburg syndrome; Werner syndrome; Wilson disease; Wiskott-Aldrich Syndrome; Wolcott-Rallison syndrome; Wolfram syndrome; X-linked agammaglobulinemia; X-linked chronic idiopathic intestinal pseudo-obstruction; X-linked cleft palate with ankyloglossia; X-linked dominant chondrodysplasia punctata; X-linked ectodermal dysplasia; X-linked Emery-Dreifuss muscular dystrophy; X-linked lissencephaly; X-linked lymphoproliferative disease; X-linked visceral heterotaxy; xanthinuria type 1; xanthinuria type 2; xeroderma pigmentosum; XPV; and Zellweger disease.

Described herein are compositions and methods for editing or detecting a target nucleic acid, wherein the target nucleic acid is a gene, a portion thereof, a transcript thereof. In some embodiments, the target nucleic acid is a reverse transcript (e.g. a cDNA) of an mRNA transcribed from the gene, or an amplicon thereof. In some embodiments, the target nucleic acid is an amplicon of at least a portion of a gene. Non-limiting examples of genes are: AAVS1, ABCA4, ABCB11, ABCC8, ABCD1, ABCG5, ABCG8, ACAD9, ACADM, ACADVL, ACAT1, ACOX1, ACSF3, ADA, ADAMTS2, ADGRG1, AGA, AGL, AGPS, AGXT, AHI1, AIRE, ALDH3A2, ALDOB, ALG6, ALK, ALKBH5, ALMS1, ALPL, AMRC9, AMT, ANAPC10, ANAPC11, ANGPTL3, APC, Apo(a), APOCIII, APOEε4, APOL1, APP, AQP2, AR, ARFRP1, ARG1, ARH, ARL13B, ARL6, ARSA, ARSB, ASL, ASNS, ASPA, ASS1, ATM ATP6V1B1, ATP7A, ATP7B, ATRX, ATXN1, ATXN10, ATXN2, ATXN3, ATXN7, ATXN8OS, AXIN1, AXIN2, B2M, BACE-1, BAK1, BAP1, BARD1, BAX2, BBS1, BBS10, BBS12, BBS2, BCKDHA, BCKDHB, BCL2L2, BCS1L, BEST1, Betaglobin gene, BIM BMPR1A, BRAF, BRAFV600E, BRCA1, BRCA2, BRIP1, BSND, C9orf72, CA4, CACNA1A, CAPN3, CASR, CBS, CCNB1 CC2D2A, CCR5, CD1, CD2, CD3, CD3D, CD3Z, CD4, CD5, CD6, CD7, CD8A, CD8B, CD9, CD14, CD18, CD19, CD21, CD22, CD23, CD27, CD28, CD30, CD33, CD34, CD36, CD38, CD40, CD40L, CD44, CD46, CD47, CD48, CD52, CD55, CD57, CD58, CD59, CD68, CD69, CD72, CD73, CD74, CD79A, CD80, CD81, CD83, CD84, CD86, CD90, CD93, CD96, CD99, CD100, CD123, CD160, CD163, CD164, CD164L2, CD166, CD200, CD204, CD207, CD209, CD226, CD244, CD247, CD274, CD276, CD300, CD320, CDC73, CDH1, CDH23, CDK11, CDK4, CDK1V1A, CDK1V1B, CDK1V1C, CDKN2A, CDKN2B, CEBPA, CELA3B, CEP290, CERKL, CFB, CFTR, CHCHD10, CHEK2, CHM, CHRNE, CIITA, CLN3, CLN5, CLN6, CLN8, CLRN1, CLTA, CNBP, CNGB1, CNGB3, COL1A1, COL1A2, COL27A1, COL4A3, COL4A4, COL4A5, COL7A1, CPS1, CPT1A, CPT2, CRB1, CREBBP, CRX, CRYAA, CTNNA1, CTNNB1, CTNND2, CTNS, CTSK, CXCL12, CYBA, CYBB, CYP11B1, CYP11B2, CYP17A1, CYP19A1, CYP27A1, DBT, DCC, DCLRE1C, DERL2, DFNA36, DFNB31, DGAT2, DHCR7, DHDDS, DICER1, DIS3L2, DLD, DMD, DMPK, DNAH5, DNAI1, DNAI2, DNM2, DNMT1, DPC4, DYSF, EDA, EDN3, EDNRB, EGFR, EIF2B5, EMC2, EMC3, EMD, EMX1, EN1, EPCAM, ERCC6, ERCC8, ESCO2, ETFA, ETFDH, ETHE1, EVC, EVC2, EYS, F5, F9, FXI, FAH, FAM161A, FANCA, FANCB, FANCC, FANCD1, FANCD2, FANCE, FANCF, FANCG, FANCI, FANCJ, FANCL, FANCM, FANCN FANCP, FANCS, FBN1, FGF14, FGFR2, FGFR3, FGA, FGB, FGG, FH, FHL1, FIX, FKRP, FKTN, FLCN, FMR1, FOXP3, FSCN2, FUS, FUT8, FVIII, FXII, FXN, G6PC, GAA, GALC, GALK1, GALT, GAMT, GATA2, GATA-4, GBA, GBE1, GCDH, GCGR, GDNF, GFAP, GFM1, GHR, GJB1, GJB2, GLA, GLB1, GLDC, GLE1, GNE, GNPTAB, GNPTG, GNS, GPC3, GPR98, GREM1, GRHPR, GRIN2B, H2AFX, H2AX, HADHA, HAX1, HBA1, HBA2, HBB, HER2, HEXA, HEXB, HFE, HGSNAT, HLCS, HMGCL, HOGA1, HOXB13, HPRPF3, HPRT1, HPS1, HPS3, HRAS, HRD1, HSD17B4, HSD3B2, HTT, HUS1, HYAL1, HYLS1, IDS, IDUA, IFITM5, IKBKAP, IL2RG, IL7R, INPP5E, IRF4, ITGB2, ITPR1, IVD, JAG1, JAK1, JAK3, KCNC3, KCND3, KCNJ11, KLHL7, KRAS, LAMA2, LAMAS, LAMB3, LAMC2, LCA5, LDLR, LDLRAP1, LHX3, LIFR, LIPA, LMNA, LOR, LOXHD1, LPL, LRAT, LRP6, LRPPRC, LRRK2, MADR2, MAN2B1, MAPT, MAX MCM6, MCOLN1, MECP2, MED17, MEFV, MEN1, MERTK, MESP2, MET, METex14, MFN2, MFSD8, MIA3, MITF, MKL2, MKS1, MLC1, MLH1, MLH3, MMAA, MMAB, MMACHC, MMADHC, MMD, MPI, MPL, MPV17, MSH2, MSH3, MSH6, MTHFD1L, MTHFR, MTM1, MTRR, MTTP, MUT, MUTYH, MYC, MYH7, MYO7A, NAGLU, NAGS, NBN NDRG1, NDUFAF5, NDUFS6, NEB, NF1, NF2, NKX2-5, NOG, NOTCH1, NOTCH2, NPC1, NPC2, NPHP1, NPHS1, NPHS2, NRAS, NR2E3, NTHL1, NTRK, NTRK1, OAT, OCT4, OFD1, OPA3, OTC, PAH, PALB2, PAQR8, PAX3, PC, PCCA, PCCB, PCDH15, PCSK9, PD1, PDCD1, PDE6B, PDGFRA, PDHA1, PDHB, PEX1, PEX10, PEX12, PEX13, PEX14, PEX16, PEX19, PEX2, PEX26, PEX3, PEX5, PEX6, PEX7, PFKM, PHGDH, PHOX2B, PKD1, PKD2, PKHD1, PKK, PLEKHG4, PMM2, PMP22, PMS1, PMS2, PNPLA3, POLD1, POLE, POMGNT1, POT1, POU5F1, PPM1A, PPP2R2B, PPT1, PRCD, PRKAG2, PRKAR1A, PRKCG, PRNP, PROM1, PROP1, PRPF31, PRPF8, PRPH2, PRPS1, PSAP, PSD95, PSEN1, PSEN2, PSRC1, PTCH1, PTEN PTS, PUS1, PYGM, RAB23, RAD50, RAD51C, RAD51D, RAG1, RAG2, RAPSN, RARS2, RB1, RDH12, RECQL4, RET, RHO, RICTOR, RMRP, ROS1, RP1, RP2, RPE65, RPGR, RPGRIP1L, RPL32P3, RS1, RTCA, RTEL1, RUNX1, SACS, SAMHD1, SCN1A, SCN2A, SDHA, SDHAF2, SDHB, SDHC, SDHD, SEL1L, SEPSECS, SER- PINA1, SERPING1, SGCA, SGCB, SGCG, SGSH, SIRT1, SLC12A3, SLC12A6, SLC17A5, SLC22A5, SLC25A13, SLC25A15, SLC26A2, SLC26A4, SLC35A3, SLC35B4, SLC37A4, SLC39A4, SLC4A11, SLC6A8, SLC7A7, SMAD3, SMAD4, SMARCA4, SMARCAL1, SMARCB1, SMARCE1, SMN1, SMPD1, SNAI2, SNCA, SNRNP200, SOD1, SOX10, SPARA7, SPTBN2, STAR, STATS, STK11, SUFU, SUMF1, SYNE1, SYNE2, SYS1, TARDBP, TAT, TBK1, TBP, TCIRG1, TCTN3, TECPR2, TERC, TERT, TFR2, TGFBR2, TGM1, TH, TLE3, TMEM127, TMEM138, TMEM216, TMEM43, TMEM67, TMPRSS6, TOP1, TOPORS, TP53, TPP1, TRAC, TRMU, TSC1, TSC2, TSFM, TSPAN14, TTBK2, TTC8, TTPA, TTR, TULP1, TYMP, UBE2G2, UBE2J1, UBE3A, USH1C, USH1G, USH2A, VEGF, VHL, VPS13A, VPS13B, VPS35, VPS45, VRK1, VSX2, VWF, WAS, WDR19, WDR48, WNT10A, WRN, WS2B, WS2C, WT1, XPA, XPC, XPF, XRCC3, YAP1, ZAC1, ZEB1, ZFYVE26, and ZNF423.

In some embodiments, the method for treating a disease comprises modifying at least one gene associated with the disease or modifying expression of the at least one gene such that the disease is treated. In some embodiments, the disease is Alzheimer's disease and the gene is selected from APP, BACE-1, PSD95, MAPT, PSEN1, PSEN2, and APOEε4. In some embodiments, the disease is Parkinson's disease and the gene is selected from SNCA, GDNF, and LRRK2. In some embodiments, the disease comprises Centronuclear myopathy and the gene is DNM2. In some embodiments, the disease is Huntington's disease and the gene is HTT. In some embodiments, the disease is Alpha-1 antitrypsin deficiency (AATD) and the gene is SERPINA1. In some embodiments, the disease is amyotrophic lateral sclerosis (ALS) and the gene is selected from SOD1, FUS, C9ORF72, ATXN2, TARDBP, and CHCHD10. In some embodiments, the disease comprises Alexander Disease and the gene is GFAP. In some embodiments, the disease comprises anaplastic large cell lymphoma and the gene is CD30. In some embodiments, the disease comprises Angelman Syndrome and the gene is UBE3A. In some embodiments, the disease comprises calcific aortic stenosis and the gene is Apo(a). In some embodiments, the disease comprises CD3Z-associated primary T-cell immunodeficiency and the gene is CD3Z or CD247. In some embodiments, the disease comprises CD18 deficiency and the gene is ITGB2. In some embodiments, the disease comprises CD40L deficiency and the gene is CD40L. In some embodiments, the disease comprises CNS trauma and the gene is VEGF. In some embodiments, the disease comprises coronary heart disease and the gene is selected from FGA, FGB, and FGG. In some embodiments, the disease comprises MECP2 Duplication syndrome and Rett syndrome and the gene is MECP2. In some embodiments, the disease comprises a bleeding disorder (coagulation) and the gene is FXI. In some embodiments, the disease comprises fragile X syndrome and the gene is FMR1. In some embodiments, the disease comprises Fuchs corneal dystrophy and the gene is selected from ZEB1, SLC4A11, and LOXHD1. In some embodiments, the disease comprises GM2-Gangliosidoses (e.g., Tay Sachs Disease, Sandhoff disease) and the gene is selected from HEXA and HEXB. In some embodiments, the disease comprises Hearing loss disorders and the gene is DFNA36. In some embodiments, the disease is Pompe disease, including infantile onset Pompe disease (IOPD) and late onset Pompe disease (LOPD) and the gene is GAA. In some embodiments, the disease is Retinitis pigmentosa and the gene is selected from PDE6B, RHO, RP1, RP2, RPGR, PRPH2, IMPDH1, PRPF31, CRB1, PRPF8, TULP1, CA4, HPRPF3, ABCA4, EYS, CERKL, FSCN2, TOPORS, SNRNP200, PRCD, NR2E3, MERTK, USH2A, PROM1, KLHL7, CNGB1, TTC8, ARL6, DHDDS, BEST1, LRAT, SPARA7, CRX, CLRN1, RPE65, and WDR19. In some embodiments, the disease comprises Leber Congenital Amaurosis Type 10 and the gene is CEP290. In some embodiments, the disease is cardiovascular disease and/or lipodystrophies and the gene is selected from ABCG5, ABCG8, AGT, ANGPTL3, APOCIII, APOA1, APOL1, ARH, CDKN2B, CFB, CXCL12, FXI, FXII, GATA-4, MIA3, MKL2, MTHFD1L, MYH7, NKX2-5, NOTCH1, PKK, PCSK9, PSRC1, SMAD3, and TTR. In some embodiments, the disease comprises acromegaly and the gene is GHR. In some embodiments, the disease comprises acute myeloid leukemia and the gene is CD22. In some embodiments, the disease is diabetes and the gene is GCGR. In some embodiments, the disease is NAFLD/NASH and the gene is selected from DGAT2 and PNPLA3. In some embodiments, the disease is cancer and the gene is selected from STAT3, YAP1, FOXP3, AR (Prostate cancer), and IRF4 (multiple myeloma). In some embodiments, the disease is cystic fibrosis and the gene is CFTR. In some embodiments, the disease is Duchenne muscular dystrophy and the gene is DMD. In some embodiments, the disease comprises angioedema and the gene is PKK. In some embodiments, the disease comprises thalassemia and the gene is TMPRSS6. In some embodiments, the disease comprises achondroplasia and the gene is FGFR3. In some embodiments, the disease comprises Cri du chat syndrome and the gene is selected from CTNND2. In some embodiments, the disease comprises sickle cell anemia and the gene is Beta globin gene. In some embodiments, the disease comprises Alagille Syndrome and the gene is selected from JAG1 and NOTCH2. In some embodiments, the disease comprises Charcot Marie Tooth disease and the gene is selected from PMP22 and MFN2. In some embodiments, the disease comprises Crouzon syndrome and the gene is selected from FGFR2, FGFR3, and FGFR3. In some embodiments, the disease comprises Dravet Syndrome and the gene is selected from SCN1A and SCN2A. In some embodiments, the disease comprises Emery-Dreifuss syndrome and the gene is selected from EMD, LMNA, SYNE1, SYNE2, FHL1, and TMEM43. In some embodiments, the disease comprises Factor V Leiden thrombophilia and the gene is F5. In some embodiments, the disease comprises Fanconi anemia and the gene is selected from FANCA, FANCB, FANCC, FANCD1, FANCD2, FANCE, FANCF, FANCG, FANCI, FANCJ, FANCL, FANCM, FANCN, FANCP, FANCS, RAD51C, and XPF. In some embodiments, the disease comprises Familial Creutzfeld-Jakob disease and the gene is PRNP. In some embodiments, the disease comprises Familial Mediterranean Fever and the gene is MEFV. In some embodiments, the disease comprises Friedreich's ataxia and the gene is FXN. In some embodiments, the disease comprises Gaucher disease and the gene is GBA. In some embodiments, the disease comprises human papilloma virus (HPV) infection and the gene is HPV E7. In some embodiments, the disease comprises hemochromatosis and the gene is HFE, optionally comprising a C282Y mutation. In some embodiments, the disease comprises Hemophilia A and the gene is FVIII. In some embodiments, the disease comprises histiocytosis and the gene is CD1. In some embodiments, the disease comprises immunodeficiency 17 and the gene is CD3D. In some embodiments, the disease comprises immunodeficiency 13 and the gene is CD4. In some embodiments, the disease comprises Common Variable Immunodeficiency and the gene is selected from CD19 and CD81. In some embodiments, the disease comprises Joubert syndrome and the gene is selected from INPP5E, TMEM216, AHI1, NPHP1, CEP290, TMEM67, RPGRIP1L, ARL13B, CC2D2A, OFD1, TMEM138, TCTN3, ZNF423, and AMRC9. In some embodiments, the disease comprises leukocyte adhesion deficiency and the gene is CD18. In some embodiments, the disease comprises Li-Fraumeni syndrome and the gene is TP53. In some embodiments, the disease comprises lymphoproliferative syndrome and the gene is CD27. In some embodiments, the disease comprises Lynch syndrome and the gene is selected from MSH2, MLH1, MSH6, PMS2, PMS1, TGFBR2, and MLH3. In some embodiments, the disease comprises mantle cell lymphoma and the gene is CD5. In some embodiments, the disease comprises Marfan syndrome and the gene is FBN1. In some embodiments, the disease comprises mastocytosis and the gene is CD2. In some embodiments, the disease comprises methylmalonic acidemia and the gene is selected from MMAA, MMAB, and MUT. In some embodiments, the disease is mycosis fungoides and the gene is CD7. In some embodiments, the disease is myotonic dystrophy and the gene is selected from CNBP and DMPK. In some embodiments, the disease comprises neurofibromatosis and the gene is selected from NF1, and NF2. In some embodiments, the disease comprises osteogenesis imperfecta and the gene is selected from COL1A1, COL1A2, and IFITM5. In some embodiments, the disease is non-small cell lung cancer and the gene is selected from KRAS, EGFR, ALK, METex14, BRAF V600E, ROS1, RET, and NTRK. In some embodiments, the disease comprises Peutz-Jeghers syndrome and the gene is STK11. In some embodiments, the disease comprises polycystic kidney disease and the gene is selected from PKD1 and PKD2. In some embodiments, the disease comprises Severe Combined Immune Deficiency and the gene is selected from IL7R, RAG1, JAK3. In some embodiments, the disease comprises PRKAG2 cardiac syndrome and the gene is PRKAG2. In some embodiments, the disease comprises spinocerebellar ataxia and the gene is selected from ATXN1, ATXN2, ATXN3, PLEKHG4, SPTBN2, CACNA1A, ATXN7, ATXN8OS, ATXN10, TTBK2, PPP2R2B, KCNC3, PRKCG, ITPR1, TBP, KCND3, and FGF14. In some embodiments, the disease comprises Usher Syndrome and the gene is selected from MYO7A, USH1C, CDH23, PCDH15, USH1G, USH2A, GPR98, DFNB31, and CLRN1. In some embodiments, the disease comprises von Willebrand disease and the gene is VWF. In some embodiments, the disease comprises Waardenburg syndrome and the gene is selected from PAX3, MITF, WS2B, WS2C, SNAI2, EDNRB, EDN3, and SOX10. In some embodiments, the disease comprises Wiskott-Aldrich Syndrome and the gene is WAS. In some embodiments, the disease comprises von Hippel-Lindau disease and the gene is VHL. In some embodiments, the disease comprises Wilson disease and the gene is ATP7B. In some embodiments, the disease comprises Zellweger syndrome and the gene is selected from PEX1, PEX2, PEX3, PEX5, PEX6, PEX10, PEX12, PEX13, PEX14, PEX16, PEX19, and PEX26. In some embodiments, the disease comprises infantile myofibromatosis and the gene is CD34. In some embodiments, the disease comprises platelet glycoprotein IV deficiency and the gene is CD36. In some embodiments, the disease comprises immunodeficiency with hyper-IgM type 3 and the gene is CD40. In some embodiments, the disease comprises hemolytic uremic syndrome and the gene is CD46. In some embodiments, the disease comprises complement hyperactivation, angiopathic thrombosis, or protein-losing enteropathy and the gene is CD55. In some embodiments, the disease comprises hemolytic anemia and the gene is CD59. In some embodiments, the disease comprises calcification of joints and arteries and the gene is CD73. In some embodiments, the disease comprises immunoglobulin alpha deficiency and the gene is CD79A. In some embodiments, the disease comprises C syndrome and the gene is CD96. In some embodiments, the disease comprises hairy cell leukemia and the gene is CD123. In some embodiments, the disease comprises histiocytic sarcoma and the gene is CD163. In some embodiments, the disease comprises autosomal dominant deafness and the gene is CD164. In some embodiments, the disease comprises immunodeficiency 25 and the gene is CD247. In some embodiments, the disease comprises methymalonic acidemia due to transcobalamin receptor defect and the gene is CD320.

Cancer

In some embodiments, the disease is cancer. In some embodiments, the cancer is a solid cancer (i.e., a tumor). In some embodiments, the cancer is selected from a blood cell cancer, a leukemia, and a lymphoma. The cancer can be a leukemia, such as, by way of non-limiting example, acute myeloid (or myelogenous) leukemia (AML), chronic myeloid (or myelogenous) leukemia (CML), acute lymphocytic (or lymphoblastic) leukemia (ALL), and chronic lymphocytic leukemia (CLL). In some embodiments, the cancer is any one of colon cancer, rectal cancer, renal-cell carcinoma, liver cancer, bladder cancer, cancer of the kidney or ureter, lung cancer, non-small cell lung cancer, cancer of the small intestine, esophageal cancer, melanoma, bone cancer, pancreatic cancer, skin cancer, brain cancer (e.g., glioblastoma), cancer of the head or neck, melanoma, uterine cancer, ovarian cancer, breast cancer, testicular cancer, cervical cancer, stomach cancer, Hodgkin's Disease, non-Hodgkin's lymphoma, and thyroid cancer.

In some embodiments, mutations are associated with cancer or are causative of cancer. The target nucleic acid, in some embodiments, comprises a portion of a gene comprising a mutation associated with cancer, a gene whose overexpression is associated with cancer, a tumor suppressor gene, an oncogene, a checkpoint inhibitor gene, a gene associated with cellular growth, a gene associated with cellular metabolism, a gene associated with cell cycle, or a combination thereof. Non-limiting examples of genes comprising a mutation associated with cancer are ABL, ACE, AF4/HRX, AKT-2, ALK, ALK/NPM, AML1, AML1/MTG8, APC, ATM AXIN2, AXL, BAP1, BARD1, BCL-2, BCL-3, BCL-6, BCR/ABL, BLM BMPR1A, BRCA1, BRCA2, BRIP1, c-MYC, CASR, CCR5, CDC73, CDH1, CDK4, CDKN1B, CDKN1C, CDKN2A, CEBPA, CHEK2, CREBBP, CTNNA1, DBL, DEK/CAN DICER1, DIS3L2, E2A/PBX1, EGFR, ENL/HRX, EPCAM, ERG/TLS, ERBB, ERBB-2, ETS-1, EWS/FLI-1, FH, FKRP, FLCN, FMS, FOS, FPS, GATA2, GCG, GLI, GPC3, GPGSP, GREM1, HER2/neu, HOX11, HOXB13, HRAS, HST, IL-3, INT-2, JAK1, JUN KIT, KS3, K-SAM, LBC, LCK, L-MYC, LYL-1, LYT-10, LYT-10/Cα1, MAS, MAX MDM-2, MEN1, MET, MITF, MLH1, MLL, MOS, MSH1, MSH2, MSH3, MSH6, MTG8/AML1, MUTYH, MYB, MY H11/CBFB, NBN NEU, NF1, NF2, N-MYC, NTHL1, OST, PALB2, PAX-5, PBX1/E2A, PCDC1, PDGFRA, PHOX2B, PMS2, POLD1, POLE, POT1, PPARG, PRAD-1, PRKAR1A, PTCH1, PTEN, RAD50, RAD51C, RAD51D, RAF, RAR/PML, RAS-H, RAS-K, RAS-N, RB1, RECQL4, REL/NRG, RET, RHOM1, RHOM2, ROS, RUNX1, SDHA, SDHAF, SDHAF2, SDHB, SDHC, SDHD, SET/CAN, SIS, SKI, SMAD4, SMARCA4, SMARCB1, SMARCE1, SRC, STK11, SUFU, TAL1, TAL2, TAN-1, TIAM1, TERC, TERT, TIMP3, TMEM127, TNF, TP53, TRAC, TSC1, TSC2, TRK, VHL, WRN, and WT1. Non-limiting examples of oncogenes are KRAS, NRAS, BRAF, MYC, CTNNB1, and EGFR. In some instances, the oncogene is a gene that encodes a cyclin dependent kinase (CDK). Non-limiting examples of CDKs are CDK1, CDK4, CDK5, CDK7, CDK8, CDK9, CDK11 and CDK20. Non-limiting examples of tumor suppressor genes are TP53, RB1, and PTEN.

Infections

Described herein are methods for treating an infection in a subject, wherein the infection is caused by one or more pathogens, parasites, or any combination thereof. Such methods can include modifying a target nucleic acid associated with the pathogen or parasite causing the infection. Compositions and methods may modify a target nucleic acid associated with the pathogen or parasite causing the infection. In some embodiments, the target nucleic acid can be in the pathogen or parasite itself or in a cell, tissue or organ of the subject that the pathogen or parasite infects. In some embodiments, the pathogen is a bacteria, a virus, a fungus, or any combination thereof. In some embodiments, the methods described herein include treating an infection cause by one or more bacterial pathogens. Such bacterial pathogens, in some embodiments, comprise, without limitation, *Acholeplasma laidlawii*, *Brucella abortus*, *Chlamydia psittaci*, *Chlamydia trachomatis*, *Cryptococcus neoformans*, *Escherichia coli*, *Legionella pneumophila*, Lyme disease spirochetes, methicillin-resistant *Staphylococcus aureus*, *Mycobacterium leprae*, *Mycobacterium tuberculosis*, *Mycoplasma arginini*, *Mycoplasma arthritidis*, *Mycoplasma genitalium*, *Mycoplasma hyorhinis*, *Mycoplasma orale*, *Mycoplasma pneumoniae*, *Mycoplasma salivarium*, *Neisseria gonorrhoeae*, *Neisseria meningitidis*, Pneumococcus, *Pseudomonas aeruginosa*, sexually transmitted infection, *Streptococcus agalactiae*, *Streptococcus pyogenes*, *Treponema pallidum*, or any combination thereof.

In some embodiments, the methods described herein include treating an infection cause by one or more viral pathogens. Such viral pathogens, in some embodiments, comprise, without limitation, adenovirus, blue tongue virus, chikungunya, coronavirus (e.g. SARS-CoV-2), cytomegalovirus, Dengue virus, Ebola, Epstein-Barr virus, feline leukemia virus, Hemophilus *influenzae* B, Hepatitis Virus A, Hepatitis Virus B, Hepatitis Virus C, herpes simplex virus I, herpes simplex virus II, human papillomavirus (HPV), human serum parvo-like virus, human T-cell leukemia viruses, immunodeficiency virus (e.g. HIV), influenza virus, lymphocytic choriomeningitis virus, measles virus, mouse mammary tumor virus, mumps virus, murine leukemia virus, polio virus, rabies virus, Reovirus, respiratory syncytial virus (RSV), rubella virus, Sendai virus, simian virus 40, Sindbis virus, varicella-zoster virus, vesicular stomatitis virus, wart virus, West Nile virus, yellow fever virus, or any combination thereof.

In some embodiments, the methods described herein include treating an infection cause by one or more parasites. Such parasites, in some embodiments comprise, without limitation, helminths, annelids, platyhelminths, nematodes, and thorny-headed worms. In some embodiments, parasitic pathogens comprise, without limitation, *Babesia bovis*, *Echinococcus granulosus*, *Eimeria tenella*, *Leishmania tropica*, *Mesocestoides corti*, *Onchocerca volvulus*, *Plasmodium falciparum*, *Plasmodium vivax*, *Schistosoma japonicum*, *Schistosoma mansoni*, *Taenia hydatigena*, *Taenia ovis*, *Taenia saginata*, *Theileria parva*, *Toxoplasma gondii*, *Trichinella spiralis*, *Trichomonas vaginalis*, *Trypanosoma brucei*, *Trypanosoma cruzi*, *Trypanosoma rangeli*, *Trypanosoma rhodesiense*, *Balantidium coli*, *Entamoeba histolytica*, *Giardia* spp., *Isospora* spp., *Trichomonas* spp., or any combination thereof.

XV. Methods of Modifying Target Nucleic Acids

Disclosed herein are compositions and methods for modifying a target nucleic acid. The target nucleic acid may be a gene or a portion thereof. Methods and compositions may modify a coding portion of a gene, a non-coding portion of a gene, or a combination thereof. Modifying at least one gene using the compositions and methods described herein can, in some embodiments, induce a reduction or increase in expression of the one or more genes. In some embodiments, the at least one modified gene results in a reduction in expression, also referred to as gene silencing. In some embodiments, the gene silencing reduces expression of one or more genes by at least 10%, at least 20%, at least 30%, at least 40%, at least 50%, at least 60%, at least 70%, at least 80%, at least 90%, or at least 95%. In some embodiments, compositions and methods remove all expression of a gene, also referred to as genetic knock out. In some embodiments, compositions and methods increase expression of one or more genes by at least 10%, at least 20%, at least 30%, at least 40%, at least 50%, at least 60%, at least 70%, at least 80%, at least 90%, or at least 100%. In some embodiments, gene silencing is accomplished by transcriptional silencing, post-transcriptional silencing, or meiotic silencing. In some embodiments, transcriptional silencing is by genomic imprinting, paramutation, transposon silencing, position effect, or RNA-directed DNA methylation. In some embodiments, post-transcriptional silencing is by RNA interference, RNA silencing, or nonsense mediated decay. In some embodiments, meiotic silencing is by transvection or meiotic silencing of unpaired DNA. In some embodiments, the at least one modified gene results in removing all expression, also referred to as the gene being knocked out (KO).

In some embodiments, a gene is modified by repairing or editing a mutation as described herein. In some cases, a Cas protein is used to effect the modification. Cas proteins may be fused to transcription activators or transcriptional repressors or deaminases or other nucleic acid modifying proteins. In some instances, compositions and methods use Cas proteins that are fused to a heterologous protein. Heterologous proteins include, but are not limited to, transcriptional activators, transcriptional repressors, deaminases, methyltransferases, acetyltransferases, and other nucleic acid modifying proteins. In some cases, Cas proteins need not be fused to a partner protein to accomplish the required protein (expression) modification.

In some embodiments, compositions and methods comprise a nucleic acid expression vector, or use thereof, to introduce a Cas protein, guide nucleic acid, donor template or any combination thereof to a cell. In some embodiments, the nucleic acid expression vector is a viral vector. Viral vectors include, but are not limited to, retroviruses, adenoviruses, adeno-associated viruses, and herpes simplex viruses. In some embodiments, the viral vector is a replication-defective viral vector, comprising an insertion of a therapeutic gene inserted in genes essential to the lytic cycle, preventing the virus from replicating and exerting cytotoxic effects. In some embodiments, the viral vector is an adeno associated viral (AAV) vector. In some embodiments, the nucleic acid expression vector is a non-viral vector. In some embodiments, compositions and methods comprise a lipid, polymer, nanoparticle, or a combination thereof, or use thereof, to introduce a Cas protein, guide nucleic acid, donor template or any combination thereof to a cell. Non-limiting examples of lipids and polymers are cationic polymers, cationic lipids, or bio-responsive polymers. In some embodiments, the bio-responsive polymer exploits chemical-physical properties of the endosomal environment (e.g., pH) to preferentially release the genetic material in the intracellular space.

In some embodiments, treatment of a disease comprises administration of a gene therapy. "Gene therapy", as used herein, comprises use of a recombinant nucleic acid (DNA or RNA), administered for the purpose to adjust, repair, replace, add, or remove a gene sequence. In some embodiments, a gene therapy comprises use of a vector to introduce a functional gene or transgene. In some embodiments, vectors comprise nonviral vectors, including cationic polymers, cationic lipids, or bio-responsive polymers. In some embodiments, the bio-responsive polymer exploits chemical-physical properties of the endosomal environment (e.g., pH) to preferentially release the genetic material in the intracellular space. In some embodiments, vectors comprise viral vectors, including retroviruses, adenoviruses, adeno-associated viruses, and herpes simplex viruses. In some embodiments, the vector comprises a replication-defective viral vector, comprising an insertion of a therapeutic gene inserted in genes essential to the lytic cycle, preventing the virus from replicating and exerting cytotoxic effects. Methods of gene therapy are described in more detail in Ingusci et al., "Gene Therapy Tools for Brain Diseases", Front. Pharmacol. 10:724 (2019) which is hereby incorporated by reference in its entirety.

It is known that CRISPR-Cas9 gene editing techniques may select for p53-mutated cells. Similarly, the presence of KRAS mutations provides a selective advantage during CRISPR-Cas9 gene editing, as further described in Sinha et al., "A systematic genome-wide mapping of oncogenic mutation selection during CRISPR-Cas9 genome editing", Nature Comm. 12:6512 (2021), which is hereby incorporated by reference in its entirety. In some embodiments, a genome targeted for treatment comprises a wild-type p53 gene, a wild-type KRAS gene, a mutated p53 gene, a mutated KRAS gene, or any combination thereof. In some embodiments, the genome comprises a p53 mutation and the target gene comprises WDR48, H2AFX, FANCG, BRIP1, HUS1, XRCC3, PALB2, FANCL, FANCA, FANCC, BRCA1, BRCA2, or any combination thereof. In some embodiments, the genome comprises a wild-type p53 and the target gene comprises CCNB1, MCM6, ANAPC11, ANAPC10, CDKN1A, or any combination thereof. In some embodiments, the genome comprises a KRAS mutation and the target gene comprises CRYAA, RTCA, LOR, SLC35B4, EN1, CELA3B, NOG, or any combination thereof.

In some instances, the compositions described herein are for use in therapy. For example, in some instances, the compositions described herein are for use in treating a disease or condition described herein.

Also provided is the use of the compositions described herein in the manufacture of a medicament. Also provided is the use of the compositions described herein in the manufacture of a medicament for therapeutic and/or prophylactic treatment of a disease or condition described herein.

XVI. Target Nucleic Acids and Samples

Disclosed herein are compositions, systems and methods for detecting and/or modifying a target nucleic acid. In some instances, the target nucleic acid is a single stranded nucleic acid. Alternatively, or in combination, the target nucleic acid is a double stranded nucleic acid and is prepared into single stranded nucleic acids before or upon contacting the reagents. In some instances, the target nucleic acid is a double stranded nucleic acid. In some instances, the double stranded nucleic acid is DNA. The target nucleic acid may be a RNA. The target nucleic acids include but are not limited to mRNA, rRNA, tRNA, non-coding RNA, long non-coding RNA, and microRNA (miRNA). In some instances, the target nucleic acid is complementary DNA (cDNA) synthesized from a single-stranded RNA template in a reaction catalyzed by a reverse transcriptase. In some cases, the target nucleic acid is single-stranded RNA (ssRNA) or mRNA. In some cases, the target nucleic acid is from a virus, a parasite, or a bacterium described herein. As another non-limiting example, the target nucleic acid may be responsible for a disease, contain a mutation (e.g., single strand polymorphism, point mutation, insertion, or deletion), be contained in an amplicon, or be uniquely identifiable from the surrounding nucleic acids (e.g., contain a unique sequence of nucleotides).

In certain embodiments, the target nucleic acid is a double stranded nucleic acid comprising a target strand and a non-target strand, wherein the target strand comprises a target sequence. In some embodiments, where a target strand comprises a target sequence, at least a portion of the engineered guide nucleic acid is complementary to the target sequence on the target strand. In some embodiments, where the target nucleic acid is a double stranded nucleic acid comprising a target strand and a non-target strand, and wherein the target strand comprises a target sequence, at least a portion of the engineered guide nucleic acid is complementary to the target sequence on the target strand. In some embodiments, a target nucleic acid comprises a PAM as described herein that is located on the non-target strand. Such a PAM described herein, in some embodiments, is adjacent (e.g., within 1, 2, 3, 4 or 5 nucleotides) to the 5' end of the target sequence on the non-target strand of the double stranded DNA molecule. In certain embodiments, such a PAM described herein is directly adjacent to the 5' end of a target sequence on the non-target strand of the double stranded DNA molecule.

In some cases, an effector protein (e.g., a D2S effector protein) or a multimeric complex thereof recognizes a PAM on a target nucleic acid. In some cases, multiple effector proteins of the multimeric complex recognize a PAM on a target nucleic acid. In some cases, only one effector protein of the multimeric complex recognizes a PAM on a target nucleic acid. In some cases, the PAM is 3' to the spacer region of the crRNA. In some cases, the PAM is directly 3' to the spacer region of the crRNA. In some cases, the PAM sequence comprises a sequence listed in TABLE 6. In some instances, the PAM sequence comprises a sequence listed in TABLE 13. In some instances the PAM sequence comprises a sequence listed in TABLE 14. In some instances the PAM sequence comprises a sequence listed in TABLE 16. In some instances the PAM sequence comprises a sequence listed in TABLE 17. In some instances, the PAM sequence comprises a sequence listed in TABLE 20. In some instances, the PAM sequence comprises a sequence listed in TABLE 21. In some instances, the PAM sequence comprises a sequence listed in TABLE 23 In some instances, the PAM sequence comprises a sequence listed in TABLE 24.

A D2S effector protein of the present disclosure, a dimer thereof, or a multimeric complex thereof may cleave or nick a target nucleic acid within or near a protospacer adjacent motif (PAM) sequence of the target nucleic acid. In some instances, cleavage occurs within 1, 2, 3, 4, 5, 6, 7, 8, 9 or 10 nucleosides of a 5' or 3' terminus of a PAM sequence. A target nucleic acid may comprise a PAM sequence adjacent to a sequence that is complementary to a guide nucleic acid spacer region. In some cases, the PAM sequence is 5'-CTT-3' (SEQ ID NO: 154). In some cases, the PAM sequence is 5'-CC-3' (SEQ ID NO: 155). In some cases, the PAM sequence is 5'-TCG-3' (SEQ ID NO: 156). In some cases, the PAM sequence is 5'-GCG-3' (SEQ ID NO: 157). In some cases, the PAM sequence is 5'-TTG-3' (SEQ ID NO: 158). In some cases, the PAM sequence is 5'-GTG-3' (SEQ ID NO: 159). In some cases, the PAM sequence is 5'-ATTA-3' (SEQ ID NO: 160). In some cases, the PAM sequence is 5'-ATTG-3' (SEQ ID NO: 161). In some cases, the PAM sequence is 5'-GTTA-3' (SEQ ID NO: 162). In some cases, the PAM sequence is 5'-GTTG-3' (SEQ ID NO: 163). In some cases, the PAM sequence is 5'-TC-3' (SEQ ID NO: 164). In some cases, the PAM sequence is 5'-ACTG-3' (SEQ ID NO: 165). In some cases, the PAM sequence is 5'-GCTG-3' (SEQ ID NO: 166). In some cases, the PAM sequence is 5'-TTC-3' (SEQ ID NO: 167). In some cases, the PAM sequence is 5'-TTT-3' (SEQ ID NO: 168).

In some cases, the PAM sequence is 5'-G-3' (SEQ ID NO: 301). In some cases, the PAM sequence is 5'-T-3' (SEQ ID NO: 302). In some cases, the PAM sequence is 5'-NRNNNNN-3' (SEQ ID NO: 303). In some cases, the PAM sequence is 5'-NNANRTT-3' (SEQ ID NO: 304). In some cases, the PAM sequence is 5'-NNKRTTN-3' (SEQ ID NO: 305). In some cases, the PAM sequence is 5'-NNNCTTN-3' (SEQ ID NO: 306). In some cases, the PAM sequence is 5'-NNNGNNN-3' (SEQ ID NO: 307). In some cases, the PAM sequence is 5'-NNNGTYG-3' (SEQ ID NO: 308). In some cases, the PAM sequence is 5'-NNNGTYN-3' (SEQ ID NO: 309). In some cases, the PAM sequence is 5'-NNNKNTK-3' (SEQ ID NO: 310). In some cases, the PAM sequence is 5'-NNNKNTT-3' (SEQ ID NO: 311). In some cases, the PAM sequence is 5'-NNNNCCN-3' (SEQ ID NO: 312). In some cases, the PAM sequence is 5'-NNNNCCR-3' (SEQ ID NO: 313). In some cases, the PAM sequence is 5'-NNNNCTT-3' (SEQ ID NO: 314). In some cases, the PAM sequence is 5'-CC-3' (SEQ ID NO: 315). In some cases, the PAM sequence is 5'-CG-3' (SEQ ID NO: 316). In some cases, the PAM sequence is 5'-CT-3' (SEQ ID NO: 317). In some cases, the PAM sequence is 5'-TG-3' (SEQ ID NO: 318). In some cases, the PAM sequence is 5'-TN-3' (SEQ ID NO: 319). In some cases, the PAM sequence is 5'-TY-3' (SEQ ID NO: 320). In some cases, the PAM sequence is 5'-3' (SEQ ID NO: 321). In some cases, the PAM sequence is 5'-R-3' (SEQ ID NO: 322). In some cases, the PAM sequence is 5'-T-3' (SEQ ID NO: 323). In some cases, the PAM sequence is 5'-NNNNRTT-3' (SEQ ID NO: 324). In some cases, the PAM sequence is 5'-NNNNTCG-3' (SEQ ID NO: 325). In some cases, the PAM sequence is 5'-NNNNKCG-3' (SEQ ID NO: 326). In some cases, the PAM sequence is 5'-NNNNKYG-3' (SEQ ID NO: 327). In some cases, the PAM sequence is 5'-NNNNTYG-3' (SEQ ID NO: 328). In some cases, the PAM sequence is 5'-NNNNTNN-3' (SEQ ID NO: 329). In some cases, the PAM sequence is 5'-NNNNTNY-3' (SEQ ID NO: 330). In some cases, the PAM sequence is 5'-NNNNTTC-3' (SEQ ID NO: 331). In some cases, the PAM sequence is 5'-NNNNTTN-3' (SEQ ID NO: 332). In some cases, the PAM sequence is 5'-NNNNTTY-3' (SEQ ID NO: 333). In some cases, the PAM sequence is 5'-NNNNTYC-3' (SEQ ID NO: 334). In some cases, the PAM sequence is 5'-NNNNTYN-3' (SEQ ID NO: 335). In some cases, the PAM sequence is 5'-NNNNTYR-3' (SEQ ID NO: 336). In some cases, the PAM sequence is 5'-NNNNYTC-3' (SEQ ID NO: 337). In some cases, the PAM sequence is 5'-NNNNYTN-3' (SEQ ID NO: 338). In some cases, the PAM sequence is 5'-NNNNYTY-3' (SEQ ID NO: 339). In some cases, the PAM sequence is 5'-C-3' (SEQ ID NO: 340). In some cases, the PAM sequence is 5'-NNNRNNG-3' (SEQ ID NO: 341). In some cases, the PAM sequence is 5'-NNNRTNG-3' (SEQ ID NO: 342). In some cases, the PAM sequence is 5'-NNNRTRG-3' (SEQ ID NO: 343). In some cases, the PAM sequence is 5'-NNNRTTG-3' (SEQ ID NO: 344). In some cases, the PAM sequence is 5'-NNNRTTN-3' (SEQ ID NO: 345). In some cases, the PAM sequence is 5'-NNNRTWG-3' (SEQ ID NO: 346). In some cases, the PAM sequence is 5'-NNNTKCG-3' (SEQ ID NO: 347). In some cases, the PAM sequence is 5'-NNNTNCG-3' (SEQ ID NO: 348). In some cases, the PAM sequence is 5'-NNNTNTG-3' (SEQ ID NO: 349). In some cases, the PAM sequence is 5'-NNNTNYN-3' (SEQ ID NO: 350). In some cases, the PAM sequence is 5'-NNNTTCN-3' (SEQ ID NO: 351). In some cases, the PAM sequence is 5'-NNNTTNY-3' (SEQ ID NO: 352). In some cases, the PAM sequence is 5'-NNNTTTN-3' (SEQ ID NO: 353). In some cases, the PAM sequence is 5'-NNNTTYN-3' (SEQ ID NO: 354). In some cases, the PAM sequence is 5'-NNNTYCT-3' (SEQ ID NO: 355). In some cases, the PAM sequence is 5'-NNN-TYYN-3' (SEQ ID NO: 356). In some cases, the PAM sequence is 5'-NNNTYYW-3' (SEQ ID NO: 357). In some cases, the PAM sequence is 5'-CT-3' (SEQ ID NO: 358). In some cases, the PAM sequence is 5'-NNNTYYT-3' (SEQ ID NO: 359). In some cases, the PAM sequence is 5'-TG-3' (SEQ ID NO: 360). In some cases, the PAM sequence is 5'-NNNWYTG-3' (SEQ ID NO: 361). In some cases, the PAM sequence is 5'-NNNYTTR-3' (SEQ ID NO: 362). In some cases, the PAM sequence is 5'-NNRGTYG-3' (SEQ ID NO: 363). In some cases, the PAM sequence is 5'-NNTNTR-3' (SEQ ID NO: 364). In some cases, the PAM sequence is 5'-NNTTTYN-3' (SEQ ID NO: 365). In some cases, the PAM sequence is 5'-NNWTTYN-3' (SEQ ID NO: 366). In some cases, the PAM sequence is 5'-NNWWTTN-3' (SEQ ID NO: 367).

In some cases, the PAM sequence is 5'-TNTG-3' (SEQ ID NO: 368). In some cases, the PAM sequence is 5'-NTCG-3' (SEQ ID NO: 369). In some cases, the PAM sequence is 5'-RTTR-3' (SEQ ID NO: 370). In some cases, the PAM sequence is 5'-NTTC-3' (SEQ ID NO: 371). In some cases, the PAM sequence is 5'-TCG-3' (SEQ ID NO: 156). In some cases, the PAM sequence is 5'-TTR-3' (SEQ ID NO: 786). In some cases, the PAM sequence is 5'-TR-3' (SEQ ID NO: 787). In some cases, the PAM sequence is 5'-TTTR-3' (SEQ ID NO: 788). In some cases, the PAM sequence is 5'-CC—3' (SEQ ID NO: 155). In some cases, the PAM sequence is 5'-TTTYC-3' (SEQ ID NO: 789). In some cases, the PAM sequence is 5'-CCN-3' (SEQ ID NO: 790). In some cases, the PAM sequence is 5'-TG-3' (SEQ ID NO: 791). In some cases, the PAM sequence is 5'-TNTG-3' (SEQ ID NO: 368). In some cases, the PAM sequence is 5'-GGTYG-3' (SEQ ID NO: 792). In some cases, the PAM sequence is 5'-TTTC-3' (SEQ ID NO: 930). In some cases, the PAM sequence is 5'-WTTR-3' (SEQ ID NO: 931).

In some cases, a PAM sequence comprises a sequence in TABLE 39. TABLE 39 shows PAM sequences that are associated with different effector proteins.

TABLE 39

PAM Sequences Associated With Various Effector Proteins

| Enzyme SEQ ID NO | Associated PAMs |
|---|---|
| 1 | CTT |
| 4 | TTC, TTTC |
| 5 | TTY |
| 8 | TTC, YTN |
| 9 | GNNN |
| 12 | YTTR, TTYN |
| 13 | CTT |
| 14 | CC |
| 15 | CC |
| 16 | CC |
| 18 | CC |
| 19 | CC |
| 20 | CC |
| 21 | TC |
| 22 | TCG |
| 23 | TCG, KYG |
| 24 | TCG |
| 25 | RTTR |
| 26 | TCG |
| 28 | RTTR |
| 29 | RTTG, RTTR |
| 30 | TCG, RTTR |
| 31 | RTTR |
| 32 | TCG, KCG |
| 33 | KNTK, KNTT |
| 34 | RTTR |
| 35 | TTC, YTC |
| 36 | TTC, TTCN |
| 37 | TTY, TY |
| 38 | TTC, TTCN |
| 39 | TYYT, YN, CTTN, T |
| 40 | TTC |
| 41 | YT, WNCT |
| 42 | TTC, TTYN, TYYW |
| 43 | TTC |
| 44 | TTY |
| 45 | TTY, TY, TTC |
| 202 | RTTN, TCG, RTTR, KRTTN |
| 203 | CCN, CCR |
| 204 | TTYN, WTTYN |
| 205 | RTTN |
| 206 | TG, TNTG, G |
| 207 | RTT, ANRTT |
| 208 | RTTR, RTWG |
| 209 | CCN |
| 210 | TTYN, YN, YTTR |
| 212 | TTTN |
| 213 | GTYG, RGTYG |
| 215 | RTRG |
| 216 | RTNG |
| 217 | RTTN |
| 219 | RTTR |
| 220 | TCG, KCG |
| 221 | TG, WNTG |
| 222 | RTTR |
| 225 | RTRG |
| 227 | TYN |
| 228 | TG, TNTG, WYTG, WNTG, |
| 229 | TCG, RTTR |
| 231 | CCN, CCR |
| 232 | TYN, WWTTN, TTTYN |
| 233 | TG, TNTG, WNTG |
| 234 | TTC, TTNY |
| 236 | TCG, RTTR |
| 237 | RTTR |
| 238 | TCG |
| 239 | CC |
| 240 | TTR, WTTR, RTRG |

In some instances, the effector protein comprises an amino acid sequence that is at least 70%, at least 75%, at least 80%, at least 85%, at least 90%, at least 95%, at least 98%, at least 99%, or 100% identical to SEQ ID NO: 1, and the target nucleic acid comprises a PAM sequence of CTT (SEQ ID NO: 154). In some instances, the effector protein comprises an amino acid sequence that is at least 70%, at least 75%, at least 80%, at least 85%, at least 90%, at least 95%, at least 98%, at least 99%, or 100% identical to SEQ ID NO: 13, and the target nucleic acid comprises a PAM sequence of CTT (SEQ ID NO: 154).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 15, and the target nucleic acid comprises a PAM sequence of CC (SEQ ID NO: 155). In some instances, the effector protein comprises an amino acid sequence that is at least 70%, at least 75%, at least 80%, at least 85%, at least 90%, at least 95%, at least 98%, at least 99%, or 100% identical to SEQ ID NO: 22, and the target nucleic acid comprises a PAM sequence of TCG (SEQ ID NO: 156). In some instances, the effector protein comprises an amino acid sequence that is at least 70%, at least 75%, at least 80%, at least 85%, at least 90%, at least 95%, at least 98%, at least 99%, or 100% identical to SEQ ID NO: 22, and the target nucleic acid comprises a PAM sequence of GCG (SEQ ID NO: 157).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 23, and the target nucleic acid comprises a PAM sequence of TCG (SEQ ID NO: 156). In some instances, the effector protein comprises an amino acid sequence that is at least 70%, at least 75%, at least 80%, at least 85%, at least 90%, at least 95%, at least 98%, at least 99%, or 100% identical to SEQ ID NO: 23, and the target nucleic acid comprises a PAM sequence of TTG (SEQ ID NO: 158). In some instances, the effector protein comprises an amino acid sequence that is at least 70%, at least 75%, at least 80%, at least 85%, at least 90%, at least 95%, at least 98%, at least 99%, or 100% identical to SEQ ID NO: 23, and the target nucleic acid comprises a PAM sequence of GCG (SEQ ID NO: 157). In some instances, the effector protein comprises an amino acid sequence that is at least 70%, at least 75%, at least 80%, at least 85%, at least 90%, at least 95%, at least 98%, at least 99%, or 100% identical to SEQ ID NO: 23, and the target nucleic acid comprises a PAM sequence of GTG (SEQ ID NO: 159).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 24, and the target nucleic acid comprises a PAM sequence of TCG (SEQ ID NO: 156).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 25, and the target nucleic acid comprises a PAM sequence of ATTA (SEQ ID NO: 160). In some instances, the effector protein comprises an amino acid sequence that is at least 70%, at least 75%, at least 80%, at least 85%, at least 90%, at least 95%, at least 98%, at least 99%, or 100% identical to SEQ ID NO: 25, and the target nucleic acid comprises a PAM sequence of ATTG (SEQ ID NO: 161). In some instances, the effector protein comprises an amino acid sequence that is at least 70%, at least 75%, at least 80%, at least 85%, at least 90%, at least 95%, at least 98%, at least 99%, or 100% identical to SEQ ID NO: 25, and the target nucleic acid comprises a PAM sequence of GTTA (SEQ ID NO: 162). In some instances, the effector protein comprises an amino acid sequence that is at least 70%, at least 75%, at least 80%, at least 85%, at least 90%, at least 95%, at least 98%, at least 99%, or 100% identical to SEQ ID NO: 25, and the target nucleic acid comprises a PAM sequence of GTTG (SEQ ID NO: 163).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 26, and the target nucleic acid comprises a PAM sequence of TCG (SEQ ID NO: 156).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 28, and the target nucleic acid comprises a PAM sequence of ATTA (SEQ ID NO: 160). In some instances, the effector protein comprises an amino acid sequence that is at least 70%, at least 75%, at least 80%, at least 85%, at least 90%, at least 95%, at least 98%, at least 99%, or 100% identical to SEQ ID NO: 28, and the target nucleic acid comprises a PAM sequence of ATTG (SEQ ID NO: 161). In some instances, the effector protein comprises an amino acid sequence that is at least 70%, at least 75%, at least 80%, at least 85%, at least 90%, at least 95%, at least 98%, at least 99%, or 100% identical to SEQ ID NO: 28, and the target nucleic acid comprises a PAM sequence of GTTA (SEQ ID NO: 1632). In some instances, the effector protein comprises an amino acid sequence that is at least 70%, at least 75%, at least 80%, at least 85%, at least 90%, at least 95%, at least 98%, at least 99%, or 100% identical to SEQ ID NO: 28, and the target nucleic acid comprises a PAM sequence of GTTG (SEQ ID NO: 163).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 31, and the target nucleic acid comprises a PAM sequence of ATTA (SEQ ID NO: 160). In some instances, the effector protein comprises an amino acid sequence that is at least 70%, at least 75%, at least 80%, at least 85%, at least 90%, at least 95%, at least 98%, at least 99%, or 100% identical to SEQ ID NO: 31, and the target nucleic acid comprises a PAM sequence of ATTG (SEQ ID NO: 161). In some instances, the effector protein comprises an amino acid sequence that is at least 70%, at least 75%, at least 80%, at least 85%, at least 90%, at least 95%, at least 98%, at least 99%, or 100% identical to SEQ ID NO: 31, and the target nucleic acid comprises a PAM sequence of GTTA (SEQ ID NO: 162). In some instances, the effector protein comprises an amino acid sequence that is at least 70%, at least 75%, at least 80%, at least 85%, at least 90%, at least 95%, at least 98%, at least 99%, or 100% identical to SEQ ID NO: 31, and the target nucleic acid comprises a PAM sequence of GTTG (SEQ ID NO: 163).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 32, and the target nucleic acid comprises a PAM sequence of TCG (SEQ ID NO: 156). In some instances, the effector protein comprises an amino acid sequence that is at least 70%, at least 75%, at least 80%, at least 85%, at least 90%, at least 95%, at least 98%, at least 99%, or 100% identical to SEQ ID NO: 32, and the target nucleic acid comprises a PAM sequence of GCG (SEQ ID NO: 157).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 21, and the target nucleic acid comprises a PAM sequence of TC (SEQ ID NO: 164).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 29, and the target nucleic acid comprises a PAM sequence of ATTG (SEQ ID NO: 161). In some instances, the effector protein comprises an amino acid sequence that is at least 70%, at least 75%, at least 80%, at least 85%, at least 90%, at least 95%, at least 98%, at least 99%, or 100% identical to SEQ ID NO: 29, and the target nucleic acid comprises a PAM sequence of ACTG (SEQ ID NO: 165). In some instances, the effector protein comprises an amino acid sequence that is at least 70%, at least 75%, at least 80%, at least 85%, at least 90%, at least 95%, at least 98%, at least 99%, or 100% identical to SEQ ID NO: 29, and the target nucleic acid comprises a PAM sequence of GTTG (SEQ ID NO: 163). In some instances, the effector protein comprises an amino acid sequence that is at least 70%, at least 75%, at least 80%, at least 85%, at least 90%, at least 95%, at least 98%, at least 99%, or 100% identical to SEQ ID NO: 29, and the target nucleic acid comprises a PAM sequence of GCTG (SEQ ID NO: 166).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 30, and the target nucleic acid comprises a PAM sequence of TCG (SEQ ID NO: 156).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 34, and the target nucleic acid comprises a PAM sequence of ATTA (SEQ ID NO: 160). In some instances, the effector protein comprises an amino acid sequence that is at least 70%, at least 75%, at least 80%, at least 85%, at least 90%, at least 95%, at least 98%, at least 99%, or 100% identical to SEQ ID NO: 34, and the target nucleic acid comprises a PAM sequence of ATTG (SEQ ID NO: 161). In some instances, the effector protein comprises an amino acid sequence that is at least 70%, at least 75%, at least 80%, at least 85%, at least 90%, at least 95%, at least 98%, at least 99%, or 100% identical to SEQ ID NO: 34, and the target nucleic acid comprises a PAM sequence of GTTA (SEQ ID NO: 162). In some instances, the effector protein comprises an amino acid sequence that is at least 70%, at least 75%, at least 80%, at least 85%, at least 90%, at least 95%, at least 98%, at least 99%, or 100% identical to SEQ ID NO: 34, and the target nucleic acid comprises a PAM sequence of GTTG (SEQ ID NO: 163).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 44, and the target nucleic acid comprises a PAM sequence of TTC (SEQ ID NO: 167).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 45, and the target nucleic acid comprises a PAM sequence of TTT (SEQ ID NO: 168). In some instances, the effector protein comprises an amino acid sequence that is at least 70%, at least 75%, at least 80%, at least 85%, at least 90%, at least 95%, at least 98%, at least 99%, or 100% identical to SEQ ID NO: 45, and the target nucleic acid comprises a PAM sequence of TTC (SEQ ID NO: 167).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 18, and the target nucleic acid comprises a PAM sequence of CC (SEQ ID NO: 155). In some instances, the effector protein comprises an amino acid sequence that is at least 70%, at least 75%, at least 80%, at least 85%, at least 90%, at least 95%, at least 98%, at least 99%, or 100% identical to SEQ ID NO: 19, and the target nucleic acid comprises a PAM sequence of CC (SEQ ID NO: 155).

In some instances, the effector protein comprises an amino acid sequence that is at least 70%, at least 75%, at least 80%, at least 85%, at least 90%, at least 95%, at least 98%, at least 99%, or 100% identical to SEQ ID NO: 43, and the target nucleic acid comprises a PAM sequence of TTC (SEQ ID NO: 167).

In some cases, the target nucleic acid comprises 5 to 100, 5 to 90, 5 to 80, 5 to 70, 5 to 60, 5 to 50, 5 to 40, 5 to 30, 5 to 25, 5 to 20, 5 to 15, or 5 to 10 linked nucleosides. In some cases, the target nucleic acid comprises 10 to 90, 20 to 80, 30 to 70, or 40 to 60 linked nucleosides. In some cases, the target nucleic acid comprises 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 60, 70, 80, 90, or 100 linked nucleosides. In some instances, the target nucleic acid comprises at least 10, at least 20, at least 30, at least 40, at least 50, at least 60, at least 70, at least 80, at least 90, or at least 100 linked nucleosides.

In some cases, the target nucleic acid is AAVS1, ABCA4, ABCB11, ABCC8, ABCD1, ACAD9, ACADM, ACADVL, ACAT1, ACOX1, ACSF3, ADA, ADAMTS2, ADGRG1, AGA, AGL, AGPS, AGXT, AHI1, AIRE, ALDH3A2, ALDOB, ALG6, ALK, ALKBH5, ALMS1, ALPL, AMRC9, AMT, ANGPTL3, APC, Apo(a), APOCIII, APOEε4, APOL1, APP, AQP2, AR, ARFRP1, ARG1, ARL13B, ARL6, ARSA, ARSB, ASL, ASNS, ASPA, ASS1, ATM, ATP6V1B1, ATP7A, ATP7B, ATRX, ATXN1, ATXN10, ATXN2, ATXN3, ATXN7, ATXN8OS, AXIN1, AXIN2, B2M, BACE-1, BAK1, BAP1, BARD1, BAX2, BBS1, BBS10, BBS12, BBS2, BCKDHA, BCKDHB, BCL2L2, BCS1L, BEST1, Betaglobin gene, BLM, BMPR1A, BRAFV600E, BRCA1, BRCA2, BRIP1, BSND, C282Y, C9orf72, CA4, CACNA1A, CAPN3, CASR, CBS, CC2D2A, CCR5, CDC73, CDH1, CDH23, CDK11, CDK4, CDKN1B, CDKN1C, CDKN2A, CEBPA, CEP290, CERKL, CFTR, CHCHD10, CHEK2, CHM, CHRNE, CIITA, CLN3, CLN5, CLN6, CLN8, CLRN1, CLTA, CNBP, CNGB1, CNGB3, COL1A1, COL1A2, COL27A1, COL4A3, COL4A4, COL4A5, COL7A1, CPS1, CPT1A, CPT2, CRB1, CRX, CTNNA1, CTNNB1, CTNND2, CTNS, CTSK, CYBA, CYBB, CYP11B1, CYP11B2, CYP17A1, CYP19A1, CYP27A1, DBT, DCLRE1C, DERL2, DFNA36, DFNB31, DGAT2, DHCR7, DHDDS, DICER1, DIS3L2, DLD, DMD, DMPK, DNAH5, DNAI1, DNAI2, DNM2, DNMT1, DYSF, EDA, EDN3, EDNRB, EGFR, EIF2B5, EMC2, EMC3, EMD, EMX1, EPCAM, ERCC6, ERCC8, ESCO2, ETFA, ETFDH, ETHE1, EVC, EVC2, EYS, F5, F9, FactorB, FactorXI, FAH, FAM161A, FANCA, FANCB, FANCC, FANCD1, FANCD2, FANCE, FANCF, FANCG, FANCI, FANCJ, FANCL, FANCM, FANCN, FANCP, FANCS, FBN1, FGF14, FGFR2, FGFR3, FH, FHL1, FKRP, FKTN, FLCN, FMR1, FOXP3, FSCN2, FUS, FUT8, FVIII, FXII, FXN, G6PC, GAA, GALC, GALK1, GALT, GAMT, GATA2, GBA, GBE1, GCDH, GCGR, GDNF, GFAP, GFM1, GHR, GJB1, GJB2, GLA, GLB1, GLDC, GLE1, GNE, GNPTAB, GNPTG, GNS, GPC3, GPR98, GREM1, GRHPR, GRIN2B, H2AX, HADHA, HAX1, HBA1, HBA2, HBB, HEXA, HEXB, HGSNAT, HLCS, HMGCL, HOGA1, HOXB13, HPRPF3, HPRT1, HPS1, HPS3, HRAS, HSD17B4, HSD3B2, HTT, HYAL1, HYLS1, IDS, IDUA, IFITM5, IKBKAP, IL2RG, IMPDH1, INPP5E, IRF4, ITPR1, IVD, JAG1, KCNC3, KCND3, KCNJ11, KLHL7, KRAS, LAMA2, LAMA3, LAMB3, LAMC2, LCA5, LDLR, LDLRAP1, LHX3, LIFR, LIPA, LMNA, LOXHD1, LPL, LRAT, LRP6, LRPPRC, LRRK2, MAN2B1, MAPT, MAX, MCOLN1, MECP2, MED17, MEFV, MEN1, MERTK, MESP2, MET, METex14, MFN2, MFSD8, MITF, MKS1, MLC1, MLH1, MLH3, MMAA, MMAB, MMACHC, MMADHC, MMD, MPI, MPL, MPV17, MSH2, MSH3, MSH6, MTHFR, MTM1, MTRR, MTTP, MUT, MUTYH, MYO7A, NAGLU, NAGS, NBN, NDRG1, NDUFAF5, NDUFS6, NEB, NF1, NF2, NOTCH2, NPC1, NPC2, NPHP1, NPHS1, NPHS2, NR2E3, NTHL1, NTRK, NTRK1, OAT, OCT4, OFD1, OPA3, OTC, PAH, PALB2, PAQR8, PAX3, PC, PCCA, PCCB, PCDH15, PCSK9, PD1, PDCD1, PDE6B, PDGFRA, PDHA1, PDHB, PEX1, PEX10, PEX12, PEX13, PEX14, PEX16, PEX19, PEX2, PEX26, PEX3, PEX5, PEX6, PEX7, PFKM, PHGDH, PHOX2B, PKD1, PKD2, PKHD1, PKK, PLEKHG4, PMM2, PMP22, PMS1, PMS2, PNPLA3, POLD1, POLE, POMGNT1, POT1, POU5F1, PPM1A, PPP2R2B, PPT1, PRCD, PRKAR1A, PRKCG, PRNP, PROM1, PROP1, PRPF31, PRPF8, PRPH2, PRPS1, PSAP, PSD95, PSEN1, PSEN2, PTCH1, PTEN, PTS, PUS1, PYGM, RAB23, RAD50, RAD51C, RAD51D, RAG2, RAPSN, RARS2, RB1, RDH12, RECQL4, RET, RHO, RICTOR, RMRP, ROS1, RP1, RP2, RPE65, RPGR, RPGRIP1L, RPL32P3, RS1, RTEL1, RUNX1, SACS, SAMHD1, SCN1A, SCN2A, SDHA, SDHAF2, SDHB, SDHC, SDHD, SEL1L, SEPSECS, SERPING1, SGCA, SGCB, SGCG, SGSH, SIRT1, SLC12A3, SLC12A6, SLC17A5, SLC22A5, SLC25A13, SLC25A15, SLC26A2, SLC26A4, SLC35A3, SLC37A4, SLC39A4, SLC4A11, SLC6A8, SLC7A7, SMAD4, SMARCA4, SMARCAL1, SMARCB1, SMARCE1, SMN1, SMPD1, SNAI2, SNCA, SNRNP200, SOD1, SOX10, SPARA7, SPTBN2, STAR, STAT3, STK11, SUFU, SUMF1, SYNE1, SYNE2, SYS1, TARDBP, TAT, TBK1, TBP, TCIRG1, TCTN3, TECPR2, TERC, TERT, TFR2, TGFBR2, TGM1, TH, TLE3, TMEM127, TMEM138, TMEM216, TMEM43, TMEM67, TMPRSS6, TOP1, TOPORS, TP53, TPP1, TRAC, TRMU, TSFM, TSPAN14, TTBK2, TTC8, TTPA, TTR, TULP1, TYMP, UBE2G2, UBE2J1, UBE3A, USH1C, USH1G, USH2A, VEGF, VHL, VPS13A, VPS13B, VPS35, VPS45, VRK1, VSX2, VWF, WDR19, WNT10A, WS2B, WS2C, XPA, XPC, XPF, YAP1, ZFYVE26, or ZNF423.

In some cases, the target nucleic acid is selected from the target nucleic acids listed in Table 4.

TABLE 4

EXEMPLARY TARGET NUCLEIC ACIDS
Exemplary target nucleic acids

DNMT1, HPRT1, RPL32P3, CCR5, FANCF, GRIN2B, EMX1
AAVS1, ALKBH5, CLTA, CDK11,
CTNNB1, AXIN1, LRP6, TBK1, BAP1, TLE3, PPM1A, BCL2L2, SUFU, RICTOR, VPS35, TOP1, SIRT1, PTEN
MMD, PAQR8,
H2AX, POU5F1, OCT4
B2M, TRAC, or CIITA, or NGCG_B2M

TABLE 4-continued

EXEMPLARY TARGET NUCLEIC ACIDS
Exemplary target nucleic acids

SYS1, ARFRP1, and TSPAN14
EMC2, EMC3, SEL1L, DERL2, UBE2G2, UBE2J1, and HRD1

In some cases, the target nucleic acid comprises a target locus. In certain embodiments, the target nucleic acid comprises more than one target loci.

In some cases, the target nucleic acid is B2M. In some cases, the B2M target nucleic acid comprises one or more target loci. In some cases, the B2M target nucleic acid comprises two target loci. In some cases, the B2M target locus comprises B2M2 or B2M4.

In some cases, the target nucleic acid is B2M, IRAC, or CIITA, NGCG_B2M, or any combination thereof. In some cases, the B2M, IRAC, or CIITA, or NGCG_B2M target nucleic acid comprises one or more target loci. In some cases, the B2M, IRAC, or CIITA, or NGCG_B2M target nucleic acid comprises two target loci.

A D2S effector protein-guide nucleic acid complex may comprise high selectivity for a target sequence. In some cases, a ribonucleoprotein may comprise a selectivity of at least 200:1, 100:1, 50:1, 20:1, 10:1, or 5:1 for a target nucleic acid over a single nucleotide variant of the target nucleic acid. In some cases, a ribonucleoprotein may comprise a selectivity of at least 5:1 for a target nucleic acid over a single nucleotide variant of the target nucleic acid. Leveraging D2S effector protein selectivity, some methods described herein may detect a target nucleic acid present in the sample in various concentrations or amounts as a target nucleic acid population. In some cases, the sample has at least 2 target nucleic acids. In some cases, the sample has at least 3, 5, 10, 20, 30, 40, 50, 100, 200, 300, 400, 500, 600, 700, 800, 900, 1000, 2000, 3000, 4000, 5000, 6000, 7000, 8000, 9000, or 10000 target nucleic acids. In some cases, the sample comprises 1 to 10,000, 100 to 8000, 400 to 6000, 500 to 5000, 1000 to 4000, or 2000 to 3000 target nucleic acids. In some cases, the method detects target nucleic acid present at least at one copy per 10 non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids.

Often, the target nucleic acid may be from 0.05% to 20% of total nucleic acids in the sample. Sometimes, the target nucleic acid is 0.1% to 10% of the total nucleic acids in the sample. The target nucleic acid, in some cases, is 0.1% to 5% of the total nucleic acids in the sample. The target nucleic acid may also be 0.1% to 1% of the total nucleic acids in the sample. The target nucleic acid may be DNA or RNA. The target nucleic acid may be any amount less than 100% of the total nucleic acids in the sample. The target nucleic acid may be 100% of the total nucleic acids in the sample.

The target nucleic acid may be 0.05% to 20% of total nucleic acids in the sample. Sometimes, the target nucleic acid is 0.1% to 10% of the total nucleic acids in the sample. The target nucleic acid, in some cases, is 0.1% to 5% of the total nucleic acids in the sample. Often, a sample comprises the segment of the target nucleic acid and at least one nucleic acid comprising less than 100% sequence identity to the segment of the target nucleic acid but no less than 50% sequence identity to the segment of the target nucleic acid. For example, the segment of the target nucleic acid comprises a mutation as compared to at least one nucleic acid comprising less than 100% sequence identity to the segment of the target nucleic acid but no less than 50% sequence identity to the segment of the target nucleic acid. Often, the segment of the target nucleic acid comprises a single nucleotide mutation as compared to at least one nucleic acid comprising less than 100% sequence identity to the segment of the target nucleic acid but no less than 50% sequence identity to the segment of the target nucleic acid.

A target nucleic acid may be an amplified nucleic acid of interest. The nucleic acid of interest may be any nucleic acid disclosed herein or from any sample as disclosed herein. The nucleic acid of interest may be an RNA that is reverse transcribed before amplification. The nucleic acid of interest may be amplified then the amplicons may be transcribed into RNA.

In some instances, compositions described herein exhibit indiscriminate trans-cleavage of ssRNA, enabling their use for detection of RNA in samples. In some cases, target ssRNA are generated from many nucleic acid templates (RNA) in order to achieve cleavage of the FQ reporter in the DETECTR platform. Certain D2S effector proteins may be activated by ssRNA, upon which they may exhibit trans-cleavage of ssRNA and may, thereby, be used to cleave ssRNA FQ reporter molecules in the DETECTR system. These D2S effector proteins may target ssRNA present in the sample or ssRNA generated and/or amplified from any number of nucleic acid templates (RNA). Described herein are reagents comprising a single stranded reporter nucleic acid comprising a detection moiety, wherein the reporter nucleic acid (e.g., the ssDNA-FQ reporter described above) is capable of being cleaved by the D2S effector protein, upon generation and amplification of ssRNA from a nucleic acid template using the methods disclosed herein, thereby generating a first detectable signal.

In some instances, target nucleic acids comprise at least one nucleic acid comprising at least 50% sequence identity to the target nucleic acid or a portion thereof. Sometimes, the at least one nucleic acid comprises an amino acid sequence that is at least 60%, 70%, 75%, 80%, 85%, 90%, 91%, 92%, 93%, 94%, 95%, 96%, 97%, 98%, or 99% identical to an equal length portion of the target nucleic acid. Sometimes, the at least one nucleic acid comprises an amino acid sequence that is 100% identical to an equal length portion of the target nucleic acid. Sometimes, the amino acid sequence of the at least one nucleic acid is at least 60%, 70%, 75%, 80%, 85%, 90%, 91%, 92%, 93%, 94%, 95%, 96%, 97%, 98%, or 99% identical to the target nucleic acid. Sometimes, the target nucleic acid comprises an amino acid sequence that is less than 60%, 70%, 75%, 80%, 85%, 90%, 91%, 92%, 93%, 94%, 95%, 96%, 97%, 98%, or 99% identical to an equal length portion of the at least one nucleic acid.

In some instances, samples comprise a target nucleic acid at a concentration of less than 1 nM, less than 2 nM, less than 3 nM, less than 4 nM, less than 5 nM, less than 6 nM, less than 7 nM, less than 8 nM, less than 9 nM, less than 10 nM, less than 20 nM, less than 30 nM, less than 40 nM, less than 50 nM, less than 60 nM, less than 70 nM, less than 80 nM, less than 90 nM, less than 100 nM, less than 200 nM, less than 300 nM, less than 400 nM, less than 500 nM, less than 600 nM, less than 700 nM, less than 800 nM, less than 900 nM, less than 1 µM, less than 2 µM, less than 3 µM, less than 4 µM, less than 5 µM, less than 6 µM, less than 7 µM, less than 8 µM, less than 9 µM, less than 10 µM, less than 100 µM, or less than 1 mM. In some instances, the sample comprises a target nucleic acid sequence at a concentration of 1 nM to 2 nM, 2 nM to 3 nM, 3 nM to 4 nM, 4 nM to 5 nM, 5 nM to 6 nM, 6 nM to 7 nM, 7 nM to 8 nM, 8 nM to 9 nM, 9 nM to 10 nM, 10 nM to 20 nM, 20 nM to 30 nM, 30 nM to 40 nM, 40 nM to 50 nM, 50 nM to 60 nM, 60 nM to 70 nM, 70 nM to 80 nM, 80 nM to 90 nM, 90 nM to 100 nM, 100 nM to 200 nM, 200 nM to 300 nM, 300 nM to 400 nM, 400 nM to 500 nM, 500 nM to 600 nM, 600 nM to 700 nM, 700 nM to 800 nM, 800 nM to 900 nM, 900 nM to 1 µM, 1 µM to 2 µM, 2 µM to 3 µM, 3 µM to 4 µM, 4 µM to 5 µM, 5 µM to 6 µM, 6 µM to 7 µM, 7 µM to 8 µM, 8 µM to 9 µM, 9 µM to 10 µM, 10 µM to 100 µM, 100 µM to 1 mM, 1 nM to 10 nM, 1 nM to 100 nM, 1 nM to 1 µM, 1 nM to 10 µM, 1 nM to 100 µM, 1 nM to 1 mM, 10 nM to 100 nM, 10 nM to 1 µM, 10 nM to 10 µM, 10 nM to 100 µM, 10 nM to 1 mM, 100 nM to 1 µM, 100 nM to 10 µM, 100 nM to 100 µM, 100 nM to 1 mM, 1 µM to 10 µM, 1 µM to 100 µM, 1 µM to 1 mM, 10 µM to 100 µM, 10 µM to 1 mM, or 100 µM to 1 mM. In some instances, the sample comprises a target nucleic acid at a concentration of 20 nM to 200 µM, 50 nM to 100 µM, 200 nM to 50 µM, 500 nM to 20 µM, or 2 µM to 10 µM. In some instances, the target nucleic acid is not present in the sample.

In some instances, samples comprise fewer than 10 copies, fewer than 100 copies, fewer than 1000 copies, fewer than 10,000 copies, fewer than 100,000 copies, or fewer than 1,000,000 copies of a target nucleic acid sequence. In some instances, the sample comprises 10 copies to 100 copies, 100 copies to 1000 copies, 1000 copies to 10,000 copies, 10,000 copies to 100,000 copies, 100,000 copies to 1,000,000 copies, 10 copies to 1000 copies, 10 copies to 10,000 copies, 10 copies to 100,000 copies, 10 copies to 1,000,000 copies, 100 copies to 10,000 copies, 100 copies to 100,000 copies, 100 copies to 1,000,000 copies, 1,000 copies to 100,000 copies, or 1,000 copies to 1,000,000 copies of a target nucleic acid sequence. In some instances, the sample comprises 10 copies to 500,000 copies, 200 copies to 200,000 copies, 500 copies to 100,000 copies, 1000 copies to 50,000 copies, 2000 copies to 20,000 copies, 3000 copies to 10,000 copies, or 4000 copies to 8000 copies. In some instances, the target nucleic acid is not present in the sample.

A number of target nucleic acid populations are consistent with the methods and compositions disclosed herein. Some methods described herein may detect two or more target nucleic acid populations present in the sample in various concentrations or amounts. In some cases, the sample has at least 2 target nucleic acid populations. In some cases, the sample has at least 3, 4, 5, 6, 7, 8, 9, 10, 20, 30, 40, or 50 target nucleic acid populations. In some cases, the sample has 3 to 50, 5 to 40, or 10 to 25 target nucleic acid populations. In some cases, the method detects target nucleic acid populations that are present at least at one copy per $10^1$ non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids. The target nucleic acid populations may be present at different concentrations or amounts in the sample.

In some instances, target nucleic acids may activate a D2S effector protein to initiate sequence-independent cleavage of a nucleic acid-based reporter (e.g., a reporter comprising an RNA sequence, or a reporter comprising DNA and RNA). For example, a D2S effector protein of the present disclosure is activated by a target nucleic acid to cleave reporters having an RNA (also referred to herein as an "RNA reporter"). Alternatively, a D2S effector protein of the present disclosure is activated by a target nucleic acid to cleave reporters having an RNA. Alternatively, a D2S effector protein of the present disclosure is activated by a target RNA to cleave reporters having an RNA (also referred to herein as a "RNA reporter"). The RNA reporter may comprise a single-stranded RNA labelled with a detection moiety or may be any RNA reporter as disclosed herein.

In some instances, the target nucleic acid as described in the methods herein does not initially comprise a PAM sequence. However, any target nucleic acid of interest may be generated using the methods described herein to comprise a PAM sequence, and thus be a PAM target nucleic acid. A PAM target nucleic acid, as used herein, refers to a target nucleic acid that has been amplified to insert a PAM sequence that is recognized by a D2S effector system.

In some instances, the target nucleic acid is in a cell. In some instances, the cell is a single-cell eukaryotic organism; a plant cell an algal cell; a fungal cell; an animal cell; a cell an invertebrate animal; a cell a vertebrate animal such as fish, amphibian, reptile, bird, and mammal; or a cell a mammal such as a human, a non-human primate, an ungulate, a feline, a bovine, an ovine, and a caprine. In preferred embodiments, the cell is a eukaryotic cell. In preferred embodiments, the cell is a mammalian cell, a human cell, or a plant cell.

In some instances, the target nucleic acid comprises a nucleic acid sequence from a pathogen responsible for a disease. Non-limiting examples of pathogens are bacteria, a virus and a fungus. The target nucleic acid, in some cases, is a portion of a nucleic acid from a sexually transmitted infection or a contagious disease. In some cases, the target nucleic acid is a portion of a nucleic acid from a genomic locus, or any DNA amplicon, such as a reverse transcribed mRNA or a cDNA from a gene locus, a transcribed mRNA, or a reverse transcribed cDNA from a gene locus in at least one of: human immunodeficiency virus (HIV), human papillomavirus (HPV), *chlamydia*, gonorrhea, syphilis, trichomoniasis, sexually transmitted infection, malaria, Dengue fever, Ebola, chikungunya, and leishmaniasis. Pathogens include viruses, fungi, helminths, protozoa, malarial parasites, *Plasmodium* parasites, *Toxoplasma* parasites, and *Schistosoma* parasites. Helminths include roundworms, heartworms, and phytophagous nematodes, flukes, *Acanthocephala*, and tapeworms. Protozoan infections include infections from *Giardia* spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, P. vivax, Trypanosoma cruzi* and *Toxoplasma gondii*. Fungal pathogens include, but are not limited to *Cryptococcus neoformans, Histoplasma capsulatum, Coccidioides immitis, Blastomyces dermatitidis, Chlamydia trachomatis*, and *Candida albicans*. Pathogenic viruses include but are not limited to coronavirus (e.g., SARS-CoV-2); immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogens include, e.g., HIV virus, *Mycobacterium tuberculosis, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus (RSV), *M. genitalium, T vaginalis*, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxoplasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium* and *M. pneumoniae*.

In some cases, the target sequence is a portion of a nucleic acid from a genomic locus, a transcribed mRNA, or a reverse transcribed cDNA from a gene locus of bacterium or other agents responsible for a disease in the sample comprising a mutation that confers resistance to a treatment, such as a single nucleotide mutation that confers resistance to antibiotic treatment.

In some embodiments, compositions, systems, and methods described herein comprise a modified target nucleic acid which can describe a target nucleic acid wherein the target nucleic acid has undergone a modification, for example, after contact with an effector protein. In some cases, the modification is an alteration in the sequence of the target nucleic acid. In some cases, the modified target nucleic acid comprises an insertion, deletion, or replacement of one or more nucleotides compared to the unmodified target nucleic acid.

In some instances, the target nucleic acid sequence comprises a nucleic acid sequence of a virus, a bacterium, or other pathogen responsible for a disease in a plant (e.g., a crop). Methods and compositions of the disclosure may be used to treat or detect a disease in a plant. For example, the methods of the disclosure may be used to target a viral nucleic acid sequence in a plant. A D2S effector protein of the disclosure (e.g., Cas14) may cleave the viral nucleic acid. In some instances, the target nucleic acid sequence comprises a nucleic acid sequence of a virus or a bacterium or other agents (e.g., any pathogen) responsible for a disease in the plant (e.g., a crop). In some instances, the target nucleic acid comprises RNA. The target nucleic acid, in some cases, is a portion of a nucleic acid from a virus or a bacterium or other agents responsible for a disease in the plant (e.g., a crop). In some cases, the target nucleic acid is a portion of a nucleic acid from a genomic locus, or any NA amplicon, such as a reverse transcribed mRNA or a cDNA from a gene locus, a transcribed mRNA, or a reverse transcribed cDNA from a gene locus in at a virus or a bacterium or other agents (e.g., any pathogen) responsible for a disease in the plant (e.g., a crop). A virus infecting the plant may be an RNA virus. A virus infecting the plant may be a DNA virus. Non-limiting examples of viruses that may be targeted with the disclosure include Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Mutations

In some instances, target nucleic acids comprise a mutation. In some embodiments, a composition, system or method described herein can be used to modify a target nucleic acid comprising a mutation such that the mutation is modified to be a wild-type nucleotide or nucleotide sequence. In some embodiments, a composition, system or method described herein can be used to detect a target nucleic acid comprising a mutation. In some instances, a sequence comprising a mutation may be modified to a wildtype sequence with a composition, system or method described herein. In some instances, a sequence comprising a mutation may be detected with a composition, system or method described herein. The mutation may be a mutation of 1, 2, 3, 4, 5, 6, 7, 8, 9, 10, 11, 12, 13, 14, 15, 16, 17, 18, 19, 20 or more nucleotides. The mutation may comprise a deletion of about 5, about 10, about 15, about 20, about 25, about 30, about 35, about 40, about 45, about 50, about 55, about 60, about 65, about 70, about 75, about 80, about 85, about 90, about 95, about 100, about 200, about 300, about 400, about 500, about 600, about 700, about 800, about 900, or about 1000 nucleotides. The mutation may comprise a deletion of 1 to 5, 5 to 10, 10 to 15, 15 to 20, 20 to 25, 25 to 30, 30 to 35, 35 to 40, 40 to 45, 45 to 50, 50 to 55, 55 to 60, 60 to 65, 65 to 70, 70 to 75, 75 to 80, 80 to 85, 85 to 90, 90 to 95, 95 to 100, 100 to 200, 200 to 300, 300 to 400, 400 to 500, 500 to 600, 600 to 700, 700 to 800, 800 to 900, 900 to 1000, 1 to 50, 1 to 100, 25 to 50, 25 to 100, 50 to 100, 100 to 500, 100 to 1000, or 500 to 1000 nucleotides. Non-limiting examples of mutations are insertion-deletion (indel), single nucleotide polymorphism (SNP), and frameshift mutations. In some instances, guide nucleic acids described herein hybridize to a region of the target nucleic acid comprising the mutation. The mutation may be located in a non-coding region or a coding region of a gene.

A mutation may be in an open reading frame of a target nucleic acid. A mutation may result in the insertion of at least one amino acid in a protein encoded by the target nucleic acid. A mutation may result in the deletion of at least one amino acid in a protein encoded by the target nucleic acid. A mutation may result in the substitution of at least one amino acid in a protein encoded by the target nucleic acid. A mutation that results in the deletion, insertion, or substitution of one or more amino acids of a protein encoded by the target nucleic acid may result in misfolding of a protein encoded by the target nucleic acid. A mutation may result in a premature stop codon, thereby resulting in a truncation of the encoded protein.

In some embodiments, a mutation comprises a point mutation or single nucleotide polymorphism (SNP), a chromosomal mutation, a copy number mutation, or any combination thereof. A point mutation optionally comprises a substitution, insertion, or deletion. In some embodiments, a mutation comprises a chromosomal mutation. A chromosomal mutations can comprise an inversion, a deletion, a duplication, or a translocation of one or more nucleotides. In some embodiments, a mutation comprises a copy number variation. A copy number variation can comprise a gene amplification or an expanding trinucleotide repeat. In some embodiments, guide nucleic acids described herein hybridize to a target sequence of a target nucleic acid comprising the mutation. In some embodiments, mutations are located in a non-coding region of a gene.

In some instances, target nucleic acids comprise a mutation, wherein the mutation is a SNP. The single nucleotide mutation or SNP may be associated with a phenotype of the sample or a phenotype of the organism from which the sample was taken. The SNP, in some cases, is associated with altered phenotype from wild type phenotype. In some embodiments, a single nucleotide mutation, SNP, or deletion described herein is associated with a disease, such as a genetic disease. The SNP may be a synonymous substitution or a nonsynonymous substitution. The nonsynonymous substitution may be a missense substitution or a nonsense point mutation. The synonymous substitution may be a silent substitution. The mutation may be a deletion of one or more nucleotides. Often, the single nucleotide mutation, SNP, or deletion is associated with a disease such as cancer or a genetic disorder. The mutation, such as a single nucleotide mutation, a SNP, or a deletion, may be encoded in the sequence of a target nucleic acid from the germline of an organism or may be encoded in a target nucleic acid from a diseased cell, such as a cancer cell.

In some embodiments, the target nucleic acid comprises a mutation associated with a disease. In some examples, a mutation associated with a disease refers to a mutation whose presence in a subject indicates that the subject is susceptible to or suffers from, a disease, disorder, condition, or syndrome. In some examples, a mutation associated with a disease refers to a mutation which causes, contributes to the development of, or indicates the existence of the disease, disorder, condition, or syndrome. A mutation associated with a disease may also refer to any mutation which generates transcription or translation products at an abnormal level, or in an abnormal form, in cells affected by a disease relative to a control without the disease. In some examples, a mutation associated with a disease refers to a mutation whose presence in a subject indicates that the subject is susceptible to, or suffers from, a disease, disorder, or pathological state. In some embodiments, a mutation associated with a disease, comprises the co-occurrence of a mutation and the phenotype of a disease. The mutation may occur in a gene, wherein transcription or translation products from the gene occur at a significantly abnormal level or in an abnormal form in a cell or subject harboring the mutation as compared to a non-disease control subject not having the mutation.

In some instances, target nucleic acids comprise a mutation, wherein the mutation is a deletion of 1, 2, 3, 4, 5, 6, 7, 8, 9, 10, 11, 12, 13, 14, 15, 16, 17, 18, 19, 20 or more nucleotides. In some embodiments, a target nucleic acid comprises a mutation of 1, 2, 3, 4, 5, 6, 7, 8, 9, 10, 11, 12, 13, 14, 15, 16, 17, 18, 19, 20 or more nucleotides. The mutation may be a deletion of about 5, about 10, about 15, about 20, about 25, about 30, about 35, about 40, about 45, about 50, about 55, about 60, about 65, about 70, about 75, about 80, about 85, about 90, about 95, about 100, about 200, about 300, about 400, about 500, about 600, about 700, about 800, about 900, or about 1000 nucleotides. The mutation may be a deletion of 1 to 5, 5 to 10, 10 to 15, 15 to 20, 20 to 25, 25 to 30, 30 to 35, 35 to 40, 40 to 45, 45 to 50, 50 to 55, 55 to 60, 60 to 65, 65 to 70, 70 to 75, 75 to 80, 80 to 85, 85 to 90, 90 to 95, 95 to 100, 100 to 200, 200 to 300, 300 to 400, 400 to 500, 500 to 600, 600 to 700, 700 to 800, 800 to 900, 900 to 1000, 1 to 50, 1 to 100, 25 to 50, 25 to 100, 50 to 100, 100 to 500, 100 to 1000, or 500 to 1000 nucleotides.

Certain Samples

Various sample types comprising a target nucleic acid of interest are consistent with the present disclosure. These samples may comprise a target nucleic acid sequence for detection. In some instances, the detection of the target nucleic acid indicates an ailment, such as a disease, cancer, or genetic disorder, or genetic information, such as for phenotyping, genotyping, or determining ancestry and are compatible with the reagents and support mediums as described herein. Generally, a sample from an individual or an animal or an environmental sample may be obtained to test for presence of a disease, cancer, genetic disorder, or any mutation of interest.

In some instances, the sample is a biological sample, an environmental sample, or a combination thereof. Non-limiting examples of biological samples are blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, and a tissue sample (e.g., a biopsy sample). A tissue sample from a subject may be dissociated or liquified prior to application to detection system of the present disclosure. Non-limiting examples of environmental samples are soil, air, or water. In some instances, an environmental sample is taken as a swab from a surface of interest or taken directly from the surface of interest.

In some instances, the sample is a raw (unprocessed, unmodified) sample. Raw samples may be applied to a system for detecting or modifying a target nucleic acid, such as those described herein. In some instances, the sample is diluted with a buffer or a fluid or concentrated prior to its application to the system or be applied neat to the detection system. Sometimes, the sample contains no more 20 µl of buffer or fluid. The sample, in some cases, is contained in no more than 1, 5, 10, 15, 20, 25, 30, 35 40, 45, 50, 55, 60, 65, 70, 75, 80, 90, 100, 200, 300, 400, 500 µl, or any of value 1 µl to 500 µl, preferably 10 µL to 200 µL, or more preferably 50 µL to 100 µL of buffer or fluid. Sometimes, the sample is contained in more than 500 µl.

In some instances, the sample is taken from a single-cell eukaryotic organism; a plant or a plant cell; an algal cell; a fungal cell; an animal cell, tissue, or organ; a cell, tissue, or organ from an invertebrate animal; a cell, tissue, fluid, or organ from a vertebrate animal such as fish, amphibian, reptile, bird, and mammal; a cell, tissue, fluid, or organ from a mammal such as a human, a non-human primate, an ungulate, a feline, a bovine, an ovine, and a caprine. In some instances, the sample is taken from nematodes, protozoans, helminths, or malarial parasites. In some cases, the sample comprises nucleic acids from a cell lysate from a eukaryotic cell, a mammalian cell, a human cell, a prokaryotic cell, or a plant cell. In some cases, the sample comprises nucleic acids expressed from a cell.

In some instances, samples are used for diagnosing a disease. In some instances the disease is cancer. The sample used for cancer testing may comprise at least one target nucleic acid that may bind to a guide nucleic acid of the reagents described herein. The target nucleic acid, in some cases, comprises a portion of a gene comprising a mutation associated with cancer, a gene whose overexpression is associated with cancer, a tumor suppressor gene, an oncogene, a checkpoint inhibitor gene, a gene associated with cellular growth, a gene associated with cellular metabolism, or a gene associated with cell cycle. Sometimes, the target nucleic acid encodes a cancer biomarker, such as a prostate cancer biomarker or non-small cell lung cancer. In some cases, the assay may be used to detect "hotspots" in target nucleic acids that may be predictive of lung cancer. In some cases, the target nucleic acid comprises a portion of a nucleic acid that is associated with a blood fever. In some cases, the target nucleic acid is a portion of a nucleic acid from a genomic locus, any DNA amplicon of, a reverse transcribed mRNA, or a cDNA from a locus of at least one of: ALK, APC, ATM, AXIN2, BAP1, BARD1, BLM, BMPR1A, BRCA1, BRCA2, BRIP1, CASR, CDC73, CDH1, CDK4, CDKN1B, CDKN1C, CDKN2A, CEBPA, CHEK2, CTNNA1, DICER1, DIS3L2, EGFR, EPCAM, FH, FLCN, GATA2, GPC3, GREM1, HOXB13, HRAS, system, MAX, MEN1, MET, MITF, MLH1, MSH2, MSH3, MSH6, MUTYH, NBN, NF1, NF2, NTHL1, PALB2, PDGFRA, PHOX2B, PMS2, POLD1, POLE, POT1, PRKAR1A, PTCH1, PTEN, RAD50, RAD51C, RAD51D, RB1, RECQL4, RET, RUNX1, SDHA, SDHAF2, SDHB, SDHC, SDHD, SMAD4, SMARCA4, SMARCB1, SMARCE1, STK11, SUFU, TERC, TERT, TMEM127, TP53, TSC1, TSC2, VHL, WRN, and WT1. Any region of the aforementioned gene loci may be probed for a mutation or deletion using the compositions and methods disclosed herein. For example, in the EGFR gene locus, the compositions and methods for detection disclosed herein may be used to detect a single nucleotide polymorphism or a deletion.

In some instances, samples are used to diagnose a genetic disorder, also referred to as genetic disorder testing. The sample used for genetic disorder testing may comprise at least one target nucleic acid that may bind to a guide nucleic acid of the reagents described herein. In some instances, the genetic disorder is hemophilia, sickle cell anemia, β-thalassemia, Duchene muscular dystrophy, severe combined immunodeficiency, Huntington's disease, or cystic fibrosis. The target nucleic acid, in some cases, is from a gene with a mutation associated with a genetic disorder, from a gene whose overexpression is associated with a genetic disorder, from a gene associated with abnormal cellular growth resulting in a genetic disorder, or from a gene associated with abnormal cellular metabolism resulting in a genetic disorder. In some cases, the target nucleic acid is a nucleic acid from a genomic locus, a transcribed mRNA, or a reverse transcribed mRNA, a DNA amplicon of or a cDNA from a locus of at least one of: CFTR, FMR1, SMN1, ABCB11, ABCC8, ABCD1, ACAD9, ACADM, ACADVL, ACAT1, ACOX1, ACSF3, ADA, ADAMTS2, ADGRG1, AGA, AGL, AGPS, AGXT, AIRE, ALDH3A2, ALDOB, ALG6, ALMS1, ALPL, AMT, AQP2, ARG1, ARSA, ARSB, ASL, ASNS, ASPA, ASS1, ATM, ATP6V1B1, ATP7A, ATP7B, ATRX, BBS1, BBS10, BBS12, BBS2, BCKDHA, BCKDHB, BCS1L, BLM, BSND, CAPN3, CBS, CDH23, CEP290, CERKL, CHM, CHRNE, CIITA, CLN3, CLN5, CLN6, CLN8, CLRN1, CNGB3, COL27A1, COL4A3, COL4A4, COL4A5, COL7A1, CPS1, CPT1A, CPT2, CRB1, CTNS, CTSK, CYBA, CYBB, CYP11B1, CYP11B2, CYP17A1, CYP19A1, CYP27A1, DBT, DCLRE1C, DHCR7, DHDDS, DLD, DMD, DNAH5, DNAI1, DNAI2, DYSF, EDA, EIF2B5, EMD, ERCC6, ERCC8, ESCO2, ETFA, ETFDH, ETHE1, EVC, EVC2, EYS, F9, FAH, FAM161A, FANCA, FANCC, FANCG, FH, FKRP, FKTN, G6PC, GAA, GALC, GALK1, GALT, GAMT, GBA, GBE1, GCDH, GFM1, GJB1, GJB2, GLA, GLB1, GLDC, GLE1, GNE, GNPTAB, GNPTG, GNS, GRHPR, HADHA, HAX1, HBA1, HBA2, HBB, HEXA, HEXB, HGSNAT, HLCS, HMGCL, HOGA1, HPS1, HPS3, HSD17B4, HSD3B2, HYAL1, HYLS1, IDS, IDUA, IKBKAP, IL2RG, WD, KCNJ11, LAMA2, LAMA3, LAMB3, LAMC2, LCA5, LDLR, LDLRAP1, LHX3, LIFR, LIPA, LOXHD1, LPL, LRPPRC, MAN2B1, MCOLN1, MED17, MESP2, MFSD8, MKS1, MLC1, MMAA, MMAB, MMACHC, MMADHC, MPI, MPL, MPV17, MTHFR, MTM1, MTRR, MTTP, MUT, MYO7A, NAGLU, NAGS, NBN, NDRG1, NDUFAF5, NDUFS6, NEB, NPC1, NPC2, NPHS1, NPHS2, NR2E3, NTRK1, OAT, OPA3, OTC, PAH, PC, PCCA, PCCB, PCDH15, PDHA1, PDHB, PEX1, PEX10, PEX12, PEX2, PEX6, PEX7, PFKM, PHGDH, PKHD1, PMM2, POMGNT1, PPT1, PROP1, PRPS1, PSAP, PTS, PUS1, PYGM, RAB23, RAG2, RAPSN, RARS2, RDH12, RMRP, RPE65, RPGRIP1L, RS1, RTEL1, SACS, SAMHD1, SEPSECS, SGCA, SGCB, SGCG, SGSH, SLC12A3, SLC12A6, SLC17A5, SLC22A5, SLC25A13, SLC25A15, SLC26A2, SLC26A4, SLC35A3, SLC37A4, SLC39A4, SLC4A11, SLC6A8, SLC7A7, SMARCAL1, SMPD1, STAR, SUMF1, TAT, TCIRG1, TECPR2, TFR2, TGM1, TH, TMEM216, TPP1, TRMU, TSFM, TTPA, TYMP, USH1C, USH2A, VPS13A, VPS13B, VPS45, VRK1, VSX2, WNT10A, XPA, XPC, and ZFYVE26.

The sample used for phenotyping testing may comprise at least one target nucleic acid that may bind to a guide nucleic acid of the reagents described herein. The target nucleic acid, in some cases, is a nucleic acid encoding a sequence associated with a phenotypic trait.

The sample used for genotyping testing may comprise at least one target nucleic acid that may bind to a guide nucleic acid of the reagents described herein. The target nucleic acid, in some cases, is a nucleic acid encoding a sequence associated with a genotype of interest.

The sample used for ancestral testing may comprise at least one target nucleic acid that may bind to a guide nucleic acid of the reagents described herein. The target nucleic acid, in some cases, is a nucleic acid encoding a sequence associated with a geographic region of origin or ethnic group.

The sample may be used for identifying a disease status. For example, a sample is any sample described herein, and is obtained from a subject for use in identifying a disease status of a subject. The disease may be a cancer or genetic disorder. Sometimes, a method comprises obtaining a serum sample from a subject; and identifying a disease status of the subject. Often, the disease status is prostate disease status, but the status of any disease may be assessed.

Any of the above disclosed samples are consistent with the methods, compositions, reagents, enzymes, and systems disclosed herein.

Exemplary Embodiments

1. A composition comprising an effector protein, or a nucleic acid encoding the effector protein, and a guide nucleic acid, or a nucleic acid encoding the guide nucleic acid, wherein the effector protein comprises an amino acid sequence that is (a) at least 50%, at least 60%, at least 70%, at least 75%, at least 80%, at least 85%, at least 90%, at least 95%, at least 98%, at least 99% or 100% identical to SEQ ID NO: 23 and (b) includes six amino acid sequences selected from the group:
  (i) an amino acid sequence that is at least 60%, at least 70%, at least 80%, at least 90%, at least 95%, at least 98%, at least 99% or 100% identical to SEQ ID NO: 793,
  (ii) an amino acid sequence that is at least 60%, at least 70%, at least 80%, at least 90%, at least 95%, at least 98%, at least 99% or 100% identical to SEQ ID NO: 794,
  (iii) an amino acid sequence that is at least 60%, at least 70%, at least 80%, at least 90%, at least 95%, at least 98%, at least 99% or 100% identical to SEQ ID NO: 795,
  (iv) an amino acid sequence that is at least 60%, at least 70%, at least 80%, at least 90%, at least 95%, at least 98%, at least 99% or 100% identical to SEQ ID NO: 796,
  (v) an amino acid sequence that is at least 60%, at least 70%, at least 80%, at least 90%, at least 95%, at least 98%, at least 99% or 100% identical to SEQ ID NO: 797,
  (vi) an amino acid sequence that is at least 60%, at least 70%, at least 80%, at least 90%, at least 95%, at least 98%, at least 99% or 100% identical to SEQ ID NO: 798, and
  (vii) an amino acid sequence that is at least 60%, at least 70%, at least 80%, at least 90%, at least 95%, at least 98%, at least 99% or 100% identical to SEQ ID NO: 799, and wherein the effector protein interacts with the guide nucleic acid to form a complex that is targeted to a target sequence via base pairing between the guide nucleic acid and the target sequence.

2. The composition of embodiment 1, wherein the effector protein comprises seven amino acid sequences selected from the group:
  (i) an amino acid sequence that is at least 40%, at least 50%, at least 60%, at least 70%, at least 80%, at least 90%, at least 95%, at least 98%, at least 99% or 100% identical to SEQ ID NO: 793,
  (ii) an amino acid sequence that is at least 40%, at least 50%, at least 60%, at least 70%, at least 80%, at least 90%, at least 95%, at least 98%, at least 99% or 100% identical to SEQ ID NO: 794,
  (iii) an amino acid sequence that is at least 40%, at least 50%, at least 60%, at least 70%, at least 80%, at least 90%, at least 95%, at least 98%, at least 99% or 100% identical to SEQ ID NO: 795,
  (iv) an amino acid sequence that is at least 40%, at least 50%, at least 60%, at least 70%, at least 80%, at least 90%, at least 95%, at least 98%, at least 99% or 100% identical to SEQ ID NO: 796,
  (v) an amino acid sequence that is at least 40%, at least 50%, at least 60%, at least 70%, at least 80%, at least 90%, at least 95%, at least 98%, at least 99% or 100% identical to SEQ ID NO: 797,
  (vi) an amino acid sequence that is at least 40%, at least 50%, at least 60%, at least 70%, at least 80%, at least 90%, at least 95%, at least 98%, at least 99% or 100% identical to SEQ ID NO: 798, and
  (vii) an amino acid sequence that is at least 40%, at least 50%, at least 60%, at least 70%, at least 80%, at least 90%, at least 95%, at least 98%, at least 99% or 100% identical to SEQ ID NO: 799.

3. The composition of embodiment 1 or embodiment 2, wherein the effector protein comprises six amino acid sequences selected from the group:
  (i) an amino acid sequence that is at least 69.5% identical to SEQ ID NO: 793,
  (ii) an amino acid sequence that is at least 69.5% identical to SEQ ID NO: 794,
  (iii) an amino acid sequence that is at least 69.5% identical to SEQ ID NO: 795,
  (iv) an amino acid sequence that is at least 69.5% identical to SEQ ID NO: 796,
  (v) an amino acid sequence that is at least 69.5% identical to SEQ ID NO: 797,
  (vi) an amino acid sequence that is at least 69.5% identical to SEQ ID NO: 798, and
  (vii) an amino acid sequence that is at least 69.5% identical to SEQ ID NO: 799.

4. The composition of any preceding embodiment, wherein the effector protein comprises six amino acid sequences selected from the group:
  (i) an amino acid sequence that is at least 80% identical to SEQ ID NO: 793,
  (ii) an amino acid sequence that is at least 80% identical to SEQ ID NO: 794, (iii) an amino acid sequence that is at least 80% identical to SEQ ID NO: 795,
(iv) an amino acid sequence that is at least 80% identical to SEQ ID NO: 796,
(v) an amino acid sequence that is at least 80% identical to SEQ ID NO: 797,
(vi) an amino acid sequence that is at least 80% identical to SEQ ID NO: 798, and
(vii) an amino acid sequence that is at least 80% identical to SEQ ID NO: 799.

5. The composition of any one of the preceding embodiments, wherein the effector protein comprises an amino acid sequence that is at least 68% identical to SEQ ID NO:23.

6. A composition comprising an effector protein, or a nucleic acid encoding the effector protein, and a guide nucleic acid, or a nucleic acid encoding the guide nucleic acid, wherein the effector protein comprises a sequence of amino acids that is at least 37%, at least 40%, at least 50%, at least 60%, at least 70%, at least 80%, at least 90%, at least 95%, at least 98%, at least 99% or 100% identical to SEQ ID NO: 796, and wherein the effector protein interacts with the guide nucleic acid to form a complex that is targeted to a target sequence via base pairing between the guide nucleic acid and the target sequence.

7. The composition of embodiment 6, wherein the effector protein further comprises four amino acid sequences selected from the group:
(i) an amino acid sequence that is at least 60%, at least 70%, at least 80%, at least 90%, at least 95%, at least 98%, at least 99% or 100% identical to SEQ ID NO: 793, preferably wherein the sequence is at least 69.5% identical to SEQ ID NO: 793,
(ii) an amino acid sequence that is at least 60%, at least 70%, at least 80%, at least 90%, at least 95%, at least 98%, at least 99% or 100% identical to SEQ ID NO: 794, preferably wherein the sequence is at least 69.5% identical to SEQ ID NO: 794,
(iii) an amino acid sequence that is at least 60%, at least 70%, at least 80%, at least 90%, at least 95%, at least 98%, at least 99% or 100% identical to SEQ ID NO: 795, preferably wherein the sequence is at least 69.5% identical to SEQ ID NO: 795,
(iv) an amino acid sequence that is at least 60%, at least 70%, at least 80%, at least 90%, at least 95%, at least 98%, at least 99% or 100% identical to SEQ ID NO: 797, preferably wherein the sequence is at least 69.5% identical to SEQ ID NO: 797,
(v) an amino acid sequence that is at least 60%, at least 70%, at least 80%, at least 90%, at least 95%, at least 98%, at least 99% or 100% identical to SEQ ID NO: 798, preferably wherein the sequence is at least 69.5% identical to SEQ ID NO: 798, and
(vi) an amino acid sequence that is at least 60%, at least 70%, at least 80%, at least 90%, at least 95%, at least 98%, at least 99% or 100% identical to SEQ ID NO: 799 preferably wherein the sequence is at least 69.5% identical to SEQ ID NO: 799.

8. The composition of embodiment 6, wherein the effector protein further comprises five amino acid sequences selected from the group:
(i) an amino acid sequence that is at least 60%, at least 70%, at least 80%, at least 90%, at least 95%, at least 98%, at least 99% or 100% identical to SEQ ID NO: 793, preferably wherein the sequence is at least 69.5% identical to SEQ ID NO: 793,
(ii) an amino acid sequence that is at least 60%, at least 70%, at least 80%, at least 90%, at least 95%, at least 98%, at least 99% or 100% identical to SEQ ID NO: 794, preferably wherein the sequence is at least 69.5% identical to SEQ ID NO: 794,
(iii) an amino acid sequence that is at least 60%, at least 70%, at least 80%, at least 90%, at least 95%, at least 98%, at least 99% or 100% identical to SEQ ID NO: 795, preferably wherein the sequence is at least 69.5% identical to SEQ ID NO: 795,
(iv) an amino acid sequence that is at least 60%, at least 70%, at least 80%, at least 90%, at least 95%, at least 98%, at least 99% or 100% identical to SEQ ID NO: 797, preferably wherein the sequence is at least 69.5% identical to SEQ ID NO: 797,
(v) an amino acid sequence that is at least 60%, at least 70%, at least 80%, at least 90%, at least 95%, at least 98%, at least 99% or 100% identical to SEQ ID NO: 798, preferably wherein the sequence is at least 69.5% identical to SEQ ID NO: 798, and
(vi) an amino acid sequence that is at least 60%, at least 70%, at least 80%, at least 90%, at least 95%, at least 98%, at least 99% or 100% identical to SEQ ID NO: 799 preferably wherein the sequence is at least 69.5% identical to SEQ ID NO: 799.

9. The composition of embodiment 6, wherein the effector protein further comprises six amino acid sequences selected from the group:
(i) an amino acid sequence that is at least 60%, at least 70%, at least 80%, at least 90%, at least 95%, at least 98%, at least 99% or 100% identical to SEQ ID NO: 793, preferably wherein the sequence is at least 69.5% identical to SEQ ID NO: 793,
(ii) an amino acid sequence that is at least 60%, at least 70%, at least 80%, at least 90%, at least 95%, at least 98%, at least 99% or 100% identical to SEQ ID NO: 794, preferably wherein the sequence is at least 69.5% identical to SEQ ID NO: 794,
(iii) an amino acid sequence that is at least 60%, at least 70%, at least 80%, at least 90%, at least 95%, at least 98%, at least 99% or 100% identical to SEQ ID NO: 795, preferably wherein the sequence is at least 69.5% identical to SEQ ID NO: 795,
(iv) an amino acid sequence that is at least 60%, at least 70%, at least 80%, at least 90%, at least 95%, at least 98%, at least 99% or 100% identical to SEQ ID NO: 797, preferably wherein the sequence is at least 69.5% identical to SEQ ID NO: 797,
(v) an amino acid sequence that is at least 60%, at least 70%, at least 80%, at least 90%, at least 95%, at least 98%, at least 99% or 100% identical to SEQ ID NO: 798, preferably wherein the sequence is at least 69.5% identical to SEQ ID NO: 798, and
(vi) an amino acid sequence that is at least 60%, at least 70%, at least 80%, at least 90%, at least 95%, at least 98%, at least 99% or 100% identical to SEQ ID NO: 799 preferably wherein the sequence is at least 69.5% identical to SEQ ID NO: 799.

10. The composition of any one of embodiments 6 to 9, wherein the effector protein comprises an amino acid sequence that is at least 50%, at least 60%, at least 70%, at least 75%, at least 80%, at least 85%, at least 90%, at least 95%, at least 98%, at least 99% or 100% identical to SEQ ID NO: 23.

11. The composition of any one of the preceding embodiments, wherein the amino acid sequences having at least the threshold identity with any one of SEQ ID NO: 793 to SEQ ID NO: 799 are in the following order starting from the N terminus:

(i) the sequence having at least the threshold identity with SEQ ID NO: 796

(ii) the sequence having at least the threshold identity with SEQ ID NO: 797

(iii) the sequence having at least the threshold identity with SEQ ID NO: 795

(iv) the sequence having at least the threshold identity with SEQ ID NO: 799

(v) the sequence having at least the threshold identity with SEQ ID NO: 794

(vi) the sequence having at least the threshold identity with SEQ ID NO: 793

(vii) the sequence having at least the threshold identity with SEQ ID NO: 798.

12. The composition of any one of the preceding embodiments, wherein the effector protein comprises an amino acid sequence that is identical to SEQ ID NO:23.

13. The composition of any one of the preceding embodiments, wherein the wherein the guide nucleic acid is an engineered guide nucleic acid.

14. The composition of any one of the preceding embodiments, wherein the guide nucleic acid comprises a repeat region that is least 75%, at least 80%, at least 85%, at least 90%, at least 95%, or 100% identical to any one of SEQ ID NOs 630, 641, and 827-929.

15. The composition of any one of the preceding embodiments wherein the guide nucleic acid comprises a crRNA and a tracrRNA, optionally wherein the guide nucleic acid is a single guide nucleic acid.

16. The composition of any one of the preceding embodiments, wherein the effector protein is about 380 to about 850 amino acids in length.

17. The composition of embodiment 16, wherein the effector protein is about 400 to about 550 amino acids in length.

18. The composition of any one of the preceding embodiments, wherein the effector protein is fused to a fusion partner.

19. The composition of embodiment 18, wherein the effector protein is fused to the fusion partner via a linker protein.

20. The composition of embodiment 18 or embodiment 19, wherein the effector protein is fused to a fusion partner at the N-terminus and/or the C-terminus.

21. The composition of any one of embodiments 18-20, wherein the fusion partner:

(a) modulates transcription;

(b) has an enzymatic activity that modifies the target nucleic acid;

(c) has an enzymatic activity that modifies a protein associated with the target nucleic acid;

(d) modifies a nucleobase of the target nucleic acid, optionally wherein the fusion partner is a deaminase;

(e) comprises a chloroplast transit peptide;

(f) comprises an endosomal escape peptide; and/or (g) comprises a nuclear localisation signal.

22. The composition of any one of the preceding embodiments, wherein the effector protein is modified to reduce the nucleic acid-cleaving activity of the effector protein.

23. The composition of embodiment 22, wherein the effector protein is enzymatically inactive.

24. The composition of any one of the preceding embodiments, wherein the composition further comprises a donor nucleic acid.

25. A method of detecting a target nucleic acid in a sample, comprising:

(a) contacting the sample with:

(i) the composition of any one of embodiments 1-23; and (ii) a reporter nucleic acid, wherein a detectable signal is produced when the reporter nucleic acid is cleaved by the effector protein.

(b) detecting the detectable signal.

26. A method of modifying a target nucleic acid, the method comprising contacting the target nucleic acid with the composition of any one of embodiments 1-24.

27. The method of embodiment 26, wherein modifying the target nucleic acid comprises cleaving the target nucleic acid, deleting a nucleotide of the target nucleic acid, inserting a nucleotide into the target nucleic acid, substituting a nucleotide of the target nucleic acid with a donor nucleotide or an additional nucleotide, or any combination thereof.

28. The method of embodiment 26 or embodiment 27, wherein the contacting occurs in vitro, in vivo or ex vivo.

29. The method of embodiment 28, wherein the contracting comprises introducing the composition of any one of embodiments 1-24 into a cell, optionally wherein the cell is a eukaryotic cell.

30. A cell modified by the method of embodiment 29.

31. The composition of any one of embodiments 1-24 for use in therapy.

32. A method of treating a patient comprising administering the composition of any one of embodiments 1-24.

EXAMPLES

The following examples are included for illustrative purposes only and are not intended to limit the scope of the invention.

Example 1: PAM Screening for D2S Effector Proteins

D2S effector proteins and guide RNA combinations represented in TABLE 5 were screened by in vitro enrichment (IVE) for PAM recognition. TABLE 5 shows the components of each effector protein-guide RNA complex assayed for PAM recognition. The amino acid sequences of the effector protein names in the second column of the table are shown in TABLE 1 herein. The nucleobase sequences of the guide components in the third through sixth columns of the table are shown in TABLE 2 and TABLE 3 herein. For example, as shown in TABLE 2, an effector protein comprising an amino acid sequence of SEQ ID NO:1 complexed with a guide comprising a crRNA of SEQ ID NO: 46 and a tracrRNA of SEQ ID NO: 91 was screened for PAM recognition. Briefly, effector proteins were complexed with corresponding guide RNAs for 15 minutes at 37° C. The complexes were added to an IVE reaction mix. PAM screening reactions used 10 µl of RNP in 100 µl reactions with 1,000 ng of a 5' PAM library in 1× Cutsmart buffer and were carried out for 15 minutes at 25° C., 45 minutes at 37° C. and 15 minutes at 45° C. Reactions were terminated with 1 µl of proteinase K and 5 µl of 500 mM EDTA for 30 minutes at 37° C. Next generation sequencing was performed on cut sequences to identify enriched PAMs. As shown in TABLE 5, cis cleavages were observed with RNP complexes comprising D2S effector proteins and corresponding guide RNAs.

TABLE 5

Observed Cis Cleavage for Effector Protein/Guide Combinations

| Comp. No: | Effector Protein | cis-cleavage (y/n) | crRNA # | tracrRNA # | sgRNA # |
|---|---|---|---|---|---|
| 1 | CasM.298706 (SEQ ID NO: 1) | Y | R4879 (SEQ ID NO: 46) | R4935 (SEQ ID NO: 91) | — |
| 4 | CasM.284933 (SEQ ID NO: 4) | Y | R4841 (SEQ ID NO: 49) | R4902 (SEQ ID NO: 94) | — |
| 13 | CasM.297894 (SEQ ID NO: 13) | Y | R4987 (SEQ ID NO: 58) | R4904 (SEQ ID NO: 103) | — |
| 14 | CasM.291449 (SEQ ID NO: 14) | N | R4875 (SEQ ID NO: 59) | R4939 (SEQ ID NO: 104) | — |
| 15 | CasM.291449 (SEQ ID NO: 14) | N | R4875 (SEQ ID NO: 59) | R4938 (SEQ ID NO: 105) | — |
| 16 | CasM.297599 (SEQ ID NO: 15) | Y | R4876 (SEQ ID NO: 60) | R4892 (SEQ ID NO: 106) | — |
| 17 | CasM.297599 (SEQ ID NO: 15) | Y | R4876 (SEQ ID NO: 60) | R4942 (SEQ ID NO: 107) | — |
| 23 | CasM.292335 (SEQ ID NO: 18) | Y | R4851 (SEQ ID NO: 63) | R4907 (SEQ ID NO: 113) | — |
| 24 | CasM.293576 (SEQ ID NO: 19) | Y | R4852 (SEQ ID NO: 64) | R4896 (SEQ ID NO: 114) | — |
| 28 | CasM.298538 (SEQ ID NO: 21) | Y | R4854 (SEQ ID NO: 66) | R4897 (SEQ ID NO: 118) | — |
| 30 | CasM.19924 (SEQ ID NO: 22) | Y | R4855 (SEQ ID NO: 67) | R4893 (SEQ ID NO: 120) | — |
| 31 | CasM.19924 (SEQ ID NO: 22) | Y | — | — | R4886 (SEQ ID NO: 149) |
| 32 | CasM.19952 (SEQ ID NO: 23) | Y | R4856 (SEQ ID NO: 68) | R4893 (SEQ ID NO: 120) | — |
| 33 | CasM.19952 (SEQ ID NO: 23) | Y | — | — | R4886 (SEQ ID NO: 149) |
| 34 | CasM.274559 (SEQ ID NO: 24) | Y | R4857 (SEQ ID NO: 69) | R4894 (SEQ ID NO: 121) | — |
| 35 | CasM.274559 (SEQ ID NO: 24) | Y | — | — | R4887 (SEQ ID NO: 150) |
| 36 | CasM.286251 (SEQ ID NO: 25) | Y | R4858 (SEQ ID NO: 70) | R4910 (SEQ ID NO: 122) | — |
| 37 | CasM.286251 (SEQ ID NO: 25) | Y | — | — | R4882 (SEQ ID NO: 151) |
| 39 | CasM.288480 (SEQ ID NO: 26) | Y | — | — | R4886 (SEQ ID NO: 149) |
| 41 | CasM.289206 289206 (SEQ ID NO: 28) | Y | R4861 (SEQ ID NO: 73) | R4894 (SEQ ID NO: 121) | — |
| 42 | CasM.289206 (SEQ ID NO: 28) | Y | — | — | R4887 (SEQ ID NO: 150) |
| 43 | CasM.290598 (SEQ ID NO: 29) | Y | R4862 (SEQ ID NO: 74) | R4894 (SEQ ID NO: 121) | — |
| 45 | CasM.290816 (SEQ ID NO: 30) | Y | R4863 (SEQ ID NO: 75) | R4912 (SEQ ID NO: 124) | — |
| 48 | CasM.295071 (SEQ ID NO: 31) | Y | — | — | R4882 (SEQ ID NO: 151) |
| 50 | CasM.295231 (SEQ ID NO: 32) | Y | — | — | R4884 (SEQ ID NO: 152) |
| 54 | CasM.279423 (SEQ ID NO: 34) | Y | R4857 (SEQ ID NO: 79) | R4894 (SEQ ID NO: 127) | — |
| 71 | CasM.295105 (SEQ ID NO: 43) | Y | R4872 (SEQ ID NO: 88) | R4925 (SEQ ID NO: 144) | — |
| 72 | CasM.295187 (SEQ ID NO: 44) | Y | R4873 (SEQ ID NO: 89) | R4945 (SEQ ID NO: 145) | — |
| 74 | CasM.295929 (SEQ ID NO: 45) | Y | R4874 (SEQ ID NO: 90) | R4928 (SEQ ID NO: 147) | — |
| 75 | CasM.295929 (SEQ ID NO: 45) | Y | R4874 (SEQ ID NO: 90) | R4927 (SEQ ID NO: 148) | — |

TABLE 6

| Comp. No | Effector Protein Name | Amino Acid SEQ ID NO: | PAM Sequence |
|---|---|---|---|
| 1 | CasM.298706 | 1 | CTT (SEQ ID NO: 154) |
| 13 | CasM.297894 | 13 | CTT (SEQ ID NO: 154) |
| 16 | CasM.297599 | 15 | CC (SEQ ID NO: 155) |
| 17 | CasM.297599 | 15 | CC (SEQ ID NO: 155) |
| 23 | CasM.292335 | 18 | CC (SEQ ID NO: 155) |
| 24 | CasM.293576 | 19 | CC (SEQ ID NO: 155) |
| 28 | CasM.298538 | 21 | TC (SEQ ID NO: 164) |
| 30 | CasM.19924 | 22 | TCG (SEQ ID NO: 156) |
| 31 | CasM.19924 | 22 | GCG (SEQ ID NO: 157) |
| 32 | CasM.19952 | 23 | TCG (SEQ ID NO: 156), TTG (SEQ ID NO: 158), GCG (SEQ ID NO: 157), GTG (SEQ ID NO: 159) |
| 33 | CasM.19952 | 23 | TCG (SEQ ID NO: 156), TTG (SEQ ID NO: 158), GCG (SEQ ID NO: 157), GTG (SEQ ID NO: 159) |
| 34 | CasM.274559 | 24 | TCG (SEQ ID NO: 156) |
| 35 | CasM.274559 | 24 | TCG (SEQ ID NO: 156) |
| 36 | CasM.286251 | 25 | ATTA (SEQ ID NO: 160), ATTG (SEQ ID NO: 161), GTTA (SEQ ID NO: 162), GTTG (SEQ ID NO: 163) |
| 37 | CasM.286251 | 25 | ATTA (SEQ ID NO: 160), ATTG (SEQ ID NO: 161), GTTA (SEQ ID NO: 162), GTTG (SEQ ID NO: 163) |
| 39 | CasM.288480 | 26 | TCG (SEQ ID NO: 156) |
| 41 | CasM.289206 | 28 | ATTA (SEQ ID NO: 160), ATTG (SEQ ID NO: 161), GTTA (SEQ ID NO: 162), GTTG (SEQ ID NO: 163) |
| 42 | CasM.289206 | 28 | ATTA (SEQ ID NO: 160), ATTG (SEQ ID NO: 161), GTTA (SEQ ID NO: 162), GTTG (SEQ ID NO: 163) |
| 43 | CasM.290598 | 29 | ATTG (SEQ ID NO: 161), ACTG (SEQ ID NO: 165), GTTG (SEQ ID NO: 163), GCTG (SEQ ID NO: 166) |
| 46 | CasM.290816 | 30 | TCG (SEQ ID NO: 156) |
| 48 | CasM.295071 | 31 | ATTA (SEQ ID NO: 160), ATTG (SEQ ID NO: 161), GTTA (SEQ ID NO: 162), GTTG (SEQ ID NO: 163) |
| 50 | CasM.295231 | 32 | TCG (SEQ ID NO: 156) or GCG (SEQ ID NO: 157) |
| 54 | CasM.279423 | 34 | ATTA (SEQ ID NO: 160), ATTG (SEQ ID NO: 161), GTTA (SEQ ID NO: 162), GTTG (SEQ ID NO: 163) |
| 71 | CasM.295105 | 43 | TTC (SEQ ID NO: 167) |
| 72 | CasM.295187 | 44 | TTC (SEQ ID NO: 167) |
| 74 | CasM.295929 | 45 | TTT (SEQ ID NO: 168), TTC (SEQ ID NO: 167) |
| 75 | CasM.295929 | 45 | TTT (SEQ ID NO: 168), TTC (SEQ ID NO: 167) |

FIG. 1 illustrates the composition of the sequences derived from libraries digested with RNP complexes comprising the denoted D2S effector proteins. As shown in FIG. 1, examination of the PFM derived WebLogos (FIG. 1) revealed the presence of enriched 5' PAM consensus sequences for the various D2S effector proteins.

Example 2: DETECTR Activity of D2S Effector Proteins

D2S effector proteins were tested for trans cleavage. Briefly, partially purified (nickel-NTA purified) D2S effector proteins were incubated with crRNA and tracrRNA or sgRNAs in a trans cleavage buffer (20 mM Tricine, 15 mM MgCl2, 0.2 mg/ml BSA, 1 mM TCEP (pH 9 at 37° C.) at room temperature for 20 minutes, followed by addition of target nucleic acid at a final concentration of 10 nM to produce effector-protein guide complexes. The components of the effector-protein guide complexes that were assayed are provided in TABLE 7. Trans cleavage activity was detected by fluorescence signal upon cleavage of a fluorophore-quencher reporter in a DETECTR reaction. Dilutions were of the effector-protein guide complexes were performed, and the assay repeated at 1%, 0.1% or 0.01% of the original protein concentration. The dilution that provided the highest signal ratio is listed.

TABLE 7

Observed Trans Cleavage for Effector Protein/Guide Combination

| Comp. No: | Effector Protein | Fold on/off ** | Dilution *** | Plasmid # | crRNA # | tracrRNA # | sgRNA # |
|---|---|---|---|---|---|---|---|
| 25 | CasM.293576 (SEQ ID NO: 19) | 1.69 | 0.1 | PL3316 | R4852 (SEQ ID NO: 64) | R4908 (SEQ ID NO: 115) | — |
| 26 | CasM.294537 (SEQ ID NO: 20) | 2.97 | 0.1 | PL3320 | R4853 (SEQ ID NO: 65) | R4941 (SEQ ID NO: 116) | — |
| 27 | CasM.294537 (SEQ ID NO: 20) | 2.05 | 0.01 | PL3320 | R4853 (SEQ ID NO: 65) | R4940 (SEQ ID NO: 117) | — |
| 31 | CasM.19924 (SEQ ID NO: 22) | 1.62 | 0.01 | PL3295 | — | — | R4886 (SEQ ID NO: 149) |
| 32 | CasM.19952 (SEQ ID NO: 23) | 2.08 | 0.1 | PL3296 | R4856 (SEQ ID NO: 68) | R4893 (SEQ ID NO: 120) | — |
| 34 | CasM.274559 (SEQ ID NO: 24) | 2.42 | 0.1 | PL3297 | R4857 (SEQ ID NO: 69) | R4894 (SEQ ID NO: 121) | — |
| 38 | CasM.288480 (SEQ ID NO: 26) | 2.74 | 0.01 | PL3307 | R4859 (SEQ ID NO: 71) | R4893 (SEQ ID NO: 120) | — |
| 39 | CasM.288480 (SEQ ID NO: 26) | 2.77 | 0.1 | PL3307 | — | — | R4886 (SEQ ID NO: 149) |
| 41 | CasM.289206 289206 (SEQ ID NO: 28) | 1.8 | 0.01 | PL3310 | R4861 (SEQ ID NO: 73) | R4894 (SEQ ID NO: 121) | — |
| 42 | CasM.289206 (SEQ ID NO: 28) | 1.58 | 0.01 | PL3310 | — | — | R4887 (SEQ ID NO: 150) |
| 44 | CasM.290598 (SEQ ID NO: 29) | 1.64 | 0.01 | PL3311 | — | — | R4887 (SEQ ID NO: 150) |
| 45 | CasM.290816 (SEQ ID NO: 30) | 1.72 | 1 | PL3312 | R4863 (SEQ ID NO: 75) | R4912 (SEQ ID NO: 124) | — |
| 46 | CasM.290816 (SEQ ID NO: 30) | 1.61 | 1 | PL3312 | — | — | R4884 (SEQ ID NO: 152) |
| 51 | CasM.292139 (SEQ ID NO: 33) | 1.64 | 0.01 | PL3314 | R4989 (SEQ ID NO: 78) | R4890 (SEQ ID NO: 125) | — |
| 53 | CasM.292139 (SEQ ID NO: 33) | 1.89 | 1 | PL3314 | | | R4885 (SEQ ID NO: 153) |
| 59 | CasM.282952 (SEQ ID NO: 37) | 1.52 | 0.01 | PL3412 | R4867 (SEQ ID NO: 82) | R4918 (SEQ ID NO: 132) | |
| 62 | CasM.283262 (SEQ ID NO: 38) | 1.66 | 0.1 | PL3413 | R4868 (SEQ ID NO: 83) | R4919 (SEQ ID NO: 135) | |
| 66 | CasM.291507 (SEQ ID NO: 41) | 2.1 | 0.01 | PL3416 | R4871(SEQ ID NO: 86) | R4944 (SEQ ID NO: 140) | |
| 74 | CasM.295929 (SEQ ID NO: 45) | 2.25 | 0.1 | PL3420 | R4874 (SEQ ID NO: 90) | R4928 (SEQ ID NO: 147) | |
| 75 | CasM.295929 (SEQ ID NO: 45) | 1.65 | 0.1 | PL3420 | R4874 (SEQ ID NO: 90) | R4927 (SEQ ID NO: 148) | |

** for those with trans-cleavage above 1.5 fold over no target
*** dilution for maximum trans cleavage activity

Example 3: CasM 19952 Edits Genomic DNA in Mammalian Cells

Figure 2:
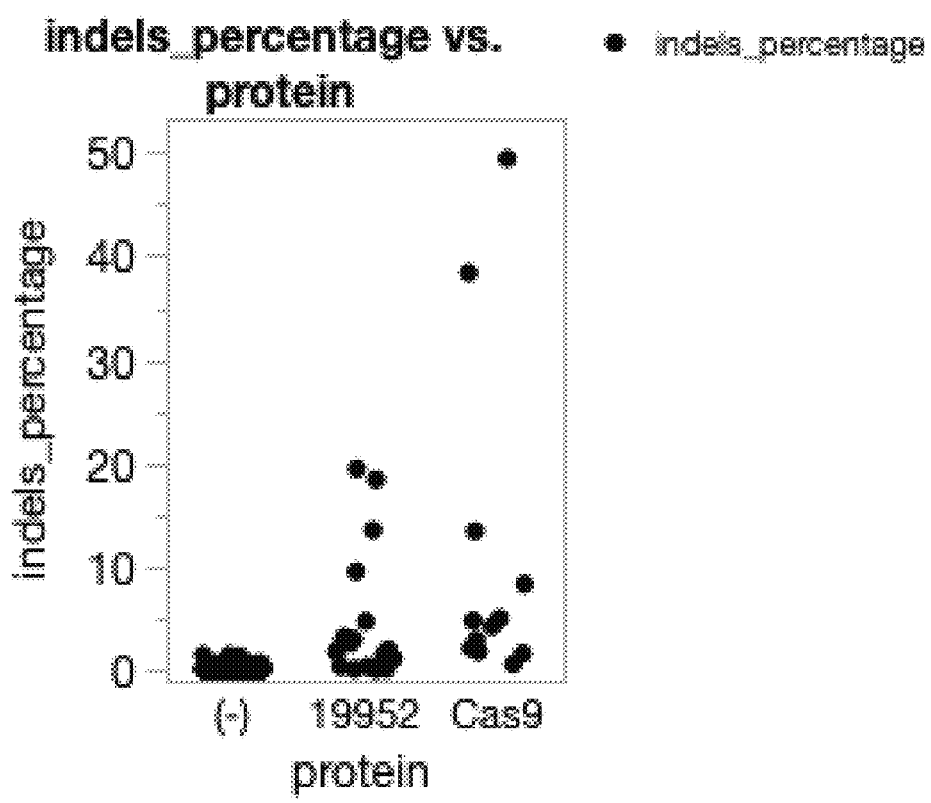
FIG. 2 shows that proteins described herein edit the genome of mammalian cells.

CasM.19952 was tested for its ability to produce indels in HEK293T cells. Briefly, a plasmid encoding CasM.19952 and a guide RNA was delivered by lipofection to HEK293T cells. This was performed for a variety of guide RNAs targeting up to twenty-four loci adjacent to biochemically determined PAM sequences. Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" and SpyCas9 were included as negative and positive controls, respectively. FIG. 2 shows the results. TABLE 8 describes the sequences of the single guide RNAs tested that provided the greatest percent of reads with indels. Non-bold, non-italicized, capital letters indicate the repeat sequence of the guide RNA; italicized letters indicate a linker; bold letters indicate the tracrRNA region; and the lowercase letters represent the spacer sequence. This experiment demonstrated that CasM.19952 is a robust editor of genomic DNA in mammalian cells.

Figure 3:
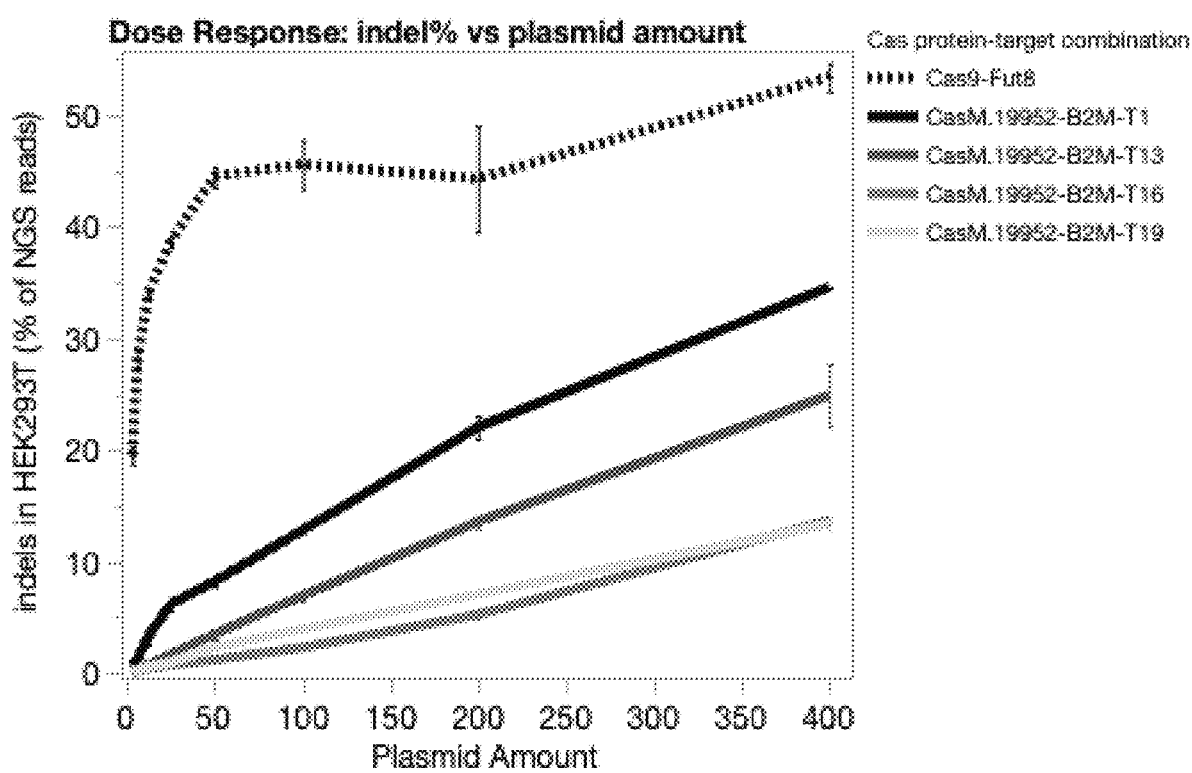
FIG. 3 shows that proteins described herein edit the genome of mammalian cells at multiple doses.

A dose-response experiment confirmed the genome editing capability of CasM.19952 in mammalian cells. Plasmids encoding CasM.19952 and single guide RNAs were delivered at various concentrations by lipofection into HEK293T. CasM.19952 was programmed to target four loci. SpyCas9 was included as a positive control. Indels were observed at all four loci. Results are shown in FIG. 3.

plasmids containing a sgRNA targeting either B2M2 or B2M4 (both normalized to 100 ng/uL, 1:1 mass of sgRNA plasmid:nuclease plasmid).

The mixture containing a CasM.19952 variant plasmid constructs and sgRNA targeting B2M2 or B2M4 DNA plasmid constructs were delivered by lipofection to HEK293T cells. Indels were detected by next generation sequencing of PCR amplicons at the targeted loci. Target and primer sequences used to amplify the amplicons can be seen in TABLE 10. Indel percentage was calculated as the fraction of sequencing reads containing insertions or deletions relative to an unedited reference sequence. Results are

TABLE 8 sgRNAs that provided genome editing with CasM.19952 in HEK293T cells

| sgRNA | percent of reads with indels |
|---|---|
| UGGGGCAGUUGGUUGCCCUUAGCCUGAGGCAUUUAUUGCACUCG GGAAGUACCAUUUCUCA*GAAA*UGGUACAUCCAACucuaggcgcccgcuaag uuc (SEQ ID NO: 180) | 13.47 |
| UGGGGCAGUUGGUUGCCCUUAGCCUGAGGCAUUUAUUGCACUCG GGAAGUACCAUUUCUCA*GAAA*UGGUACAUCCAACcccggguaagccugucu gcu (SEQ ID NO: 181) | 4.63 |
| UGGGGCAGUUGGUUGCCCUUAGCCUGAGGCAUUUAUUGCACUCG GGAAGUACCALUUCUCA*GAAA*UGGUACAUCCAACcgugcugnuuccucccc acg (SEQ ID NO: 182) | 19.40 |
| UGGGGCAGUUGGUUGCCCUUAGCCUGAGGCAUUUAUUGCACUCG GGAAGUACCAUUUCUCA*GAAA*UGGUACAUCCAACgugccuuaguuucuuca ucu (SEQ ID NO: 183) | 3.15 |
| UGGGGCAGUUGGUUGCCCUUAGCCUGAGGCAUUUAUUGCACUCG GGAAGUACCAUUUCUCA*GAAA*UGGUACAUCCAACgggggcggggggagaa aaa (SEQ ID NO: 184) | 18.35 |
| UGGGGCAGUUGGUUGCCCUUAGCCUGAGGCAUUUAUUGCACUCG GGAAGUACCAUUUCUCA*GAAA*UGGUACAUCCAACgcgcccuccgaucuggg gug (SEQ ID NO: 185) | 9.48 |

Example 4: CasM 19952 Variants Edit Genomic DNA in Mammalian Cells with Greater Efficiency Variants of CasM.19952 were generated and tested to identify variants with increased binding affinity and greater genomic editing efficiency relative to that of CasM.19952. Briefly, plasmid constructs encoding variants of CasM.19952 (SEQ ID NO: 23) were generated by mutating nucleotides that encode single amino acids of interest within the REC, RuvC-I, or RuvC-II domain from the wild-type residue to arginine, with the exception of residues that were already arginine. Generated variants had a single amino acid alteration—an arginine (R)—at amino acid positions A110, T111, E112, M113, S114, T115, Q116, S117, L118, S119, F122, A123, T124, E125, L126, E127, T128, N129, I130, F131, A132, K261, V263, V264, G265, V266, D267, L268, G269, I270, N271, V272, P273, A274, Y275, V276, A277, T278, N279, I280, T281, E282, I457, A458, N459, S460, K461, D462, I463, I464, K466, N467, or E468 as set forth in SEQ ID NOS: 241-293 of TABLE 9 (positions identified with respect to SEQ ID NO: 23). Wild-type CasM.19952 (wt) (SEQ ID NO: 23) was included as a control.

Plasmid preparations of the various constructs were assessed for purity by absorbance and normalized to 100 ng/uL.

Figure 4:
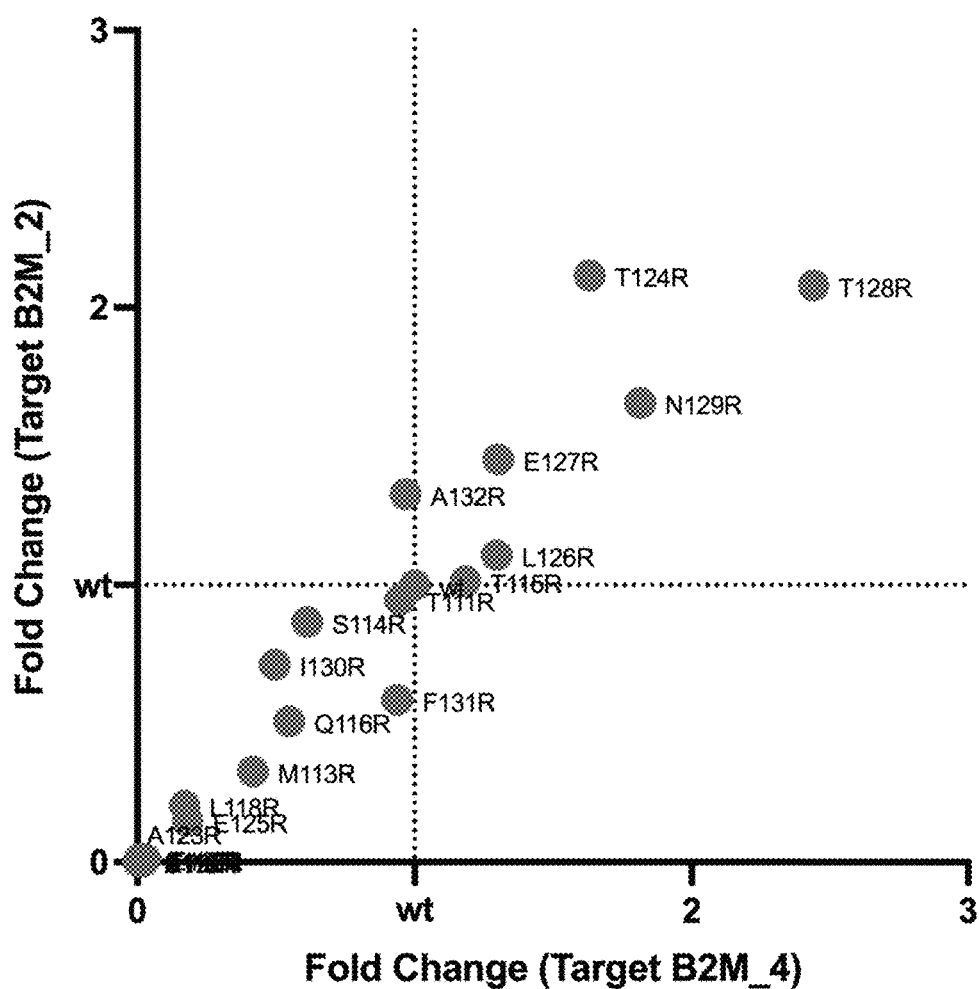
FIG. 4 show that proteins described herein, with a REC domain alteration, bind two genome loci of mammalian cells and edit the genome at the locus with varying efficacy normalized to the wild-type. The x and y-axis of the plot corresponds to various targeted loci. The identifier next to each plotted data point denotes the amino acid residue alteration and position in reference to SEQ ID NO: 23.
Figure 5:
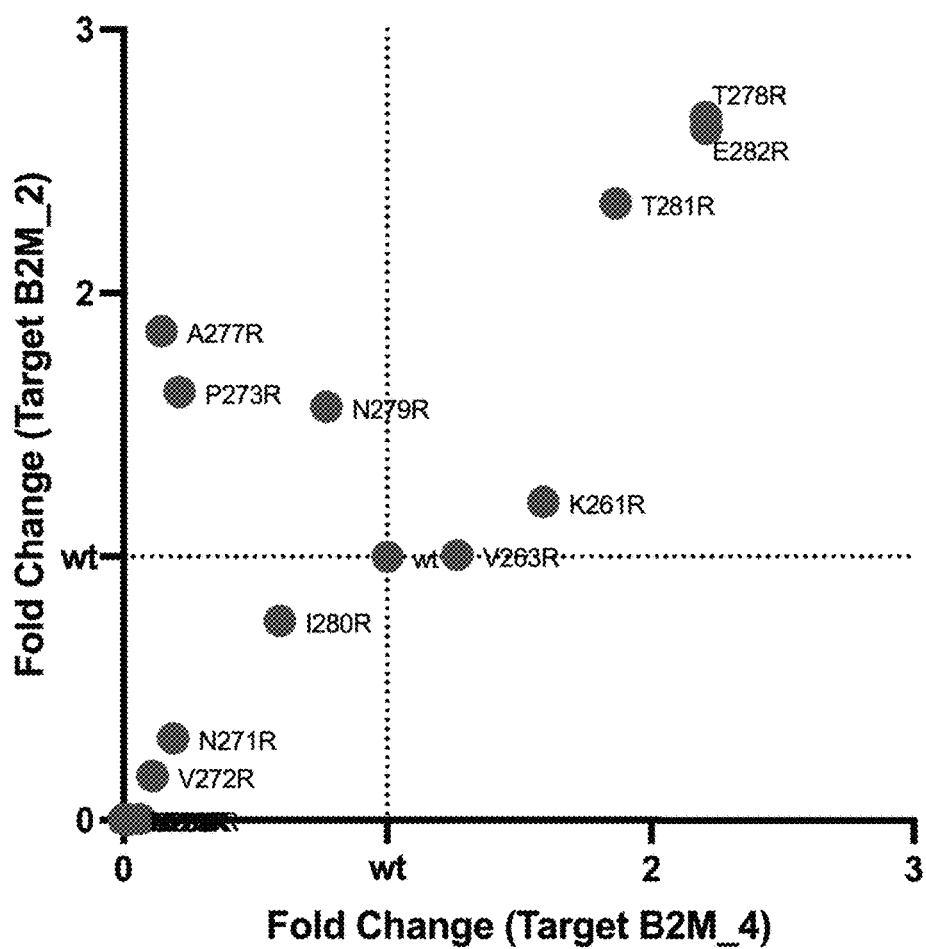
FIG. 5 show that proteins described herein, with a RuvC-I domain alteration, bind two genome loci of mammalian cells and edit the genome at the locus with varying efficacy normalized to the wild-type. The x and y-axis of the plot corresponds to various targeted loci. The identifier next to each plotted data point denotes the amino acid residue alteration and position in reference to SEQ ID NO: 23.
Figure 6:
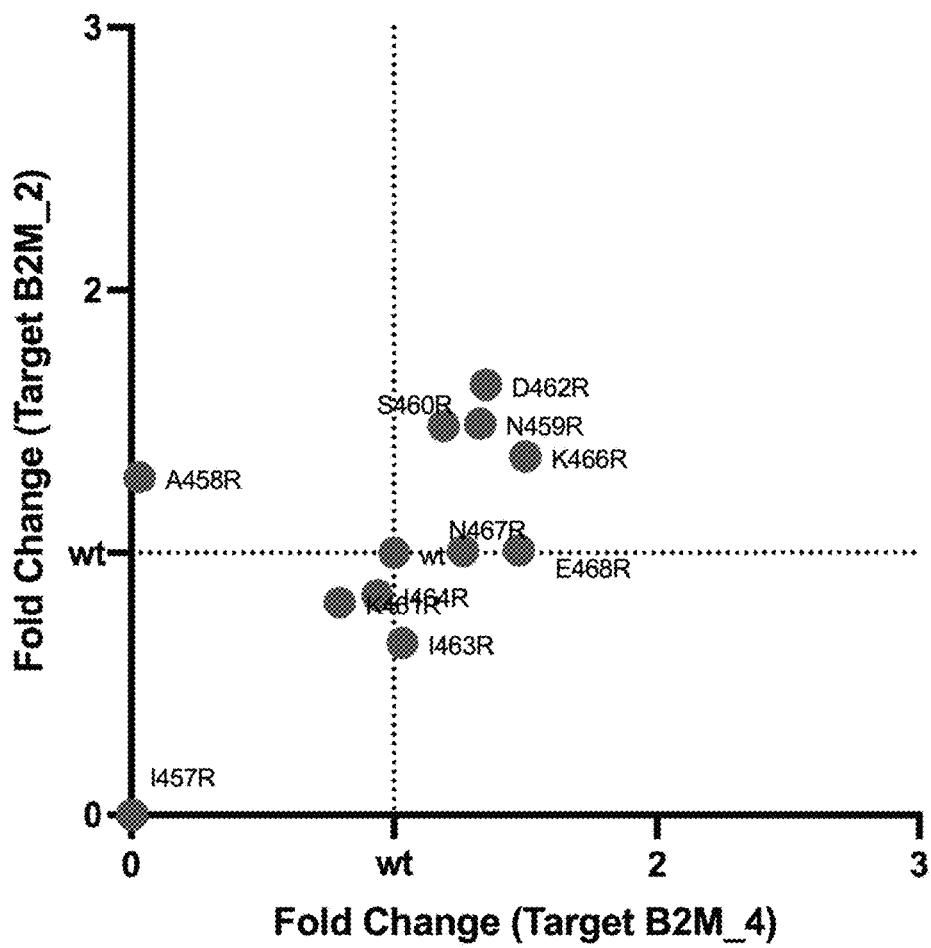
FIG. 6 show that proteins described herein, with a RuvC-II domain alteration, bind two genome loci of mammalian cells and edit the genome at the locus with varying efficacy normalized to the wild-type. The x and y-axis of the plot corresponds to various targeted loci. The identifier next to each plotted data point denotes the amino acid residue alteration and position in reference to SEQ ID NO: 23.
Figure 7A:
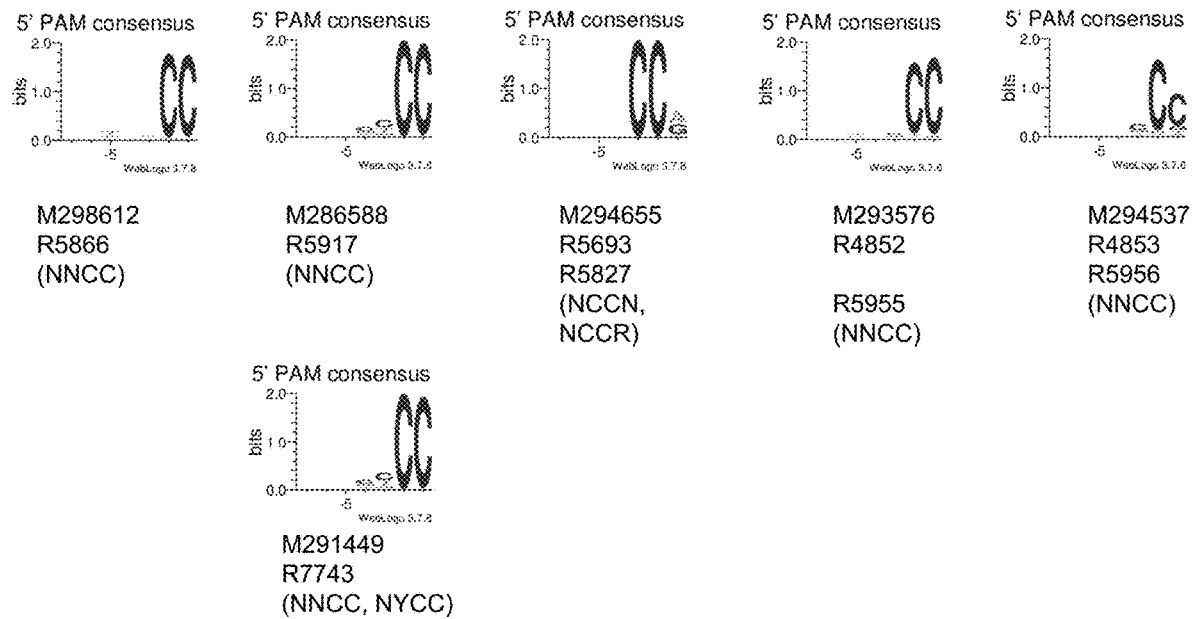
Figure 7B:
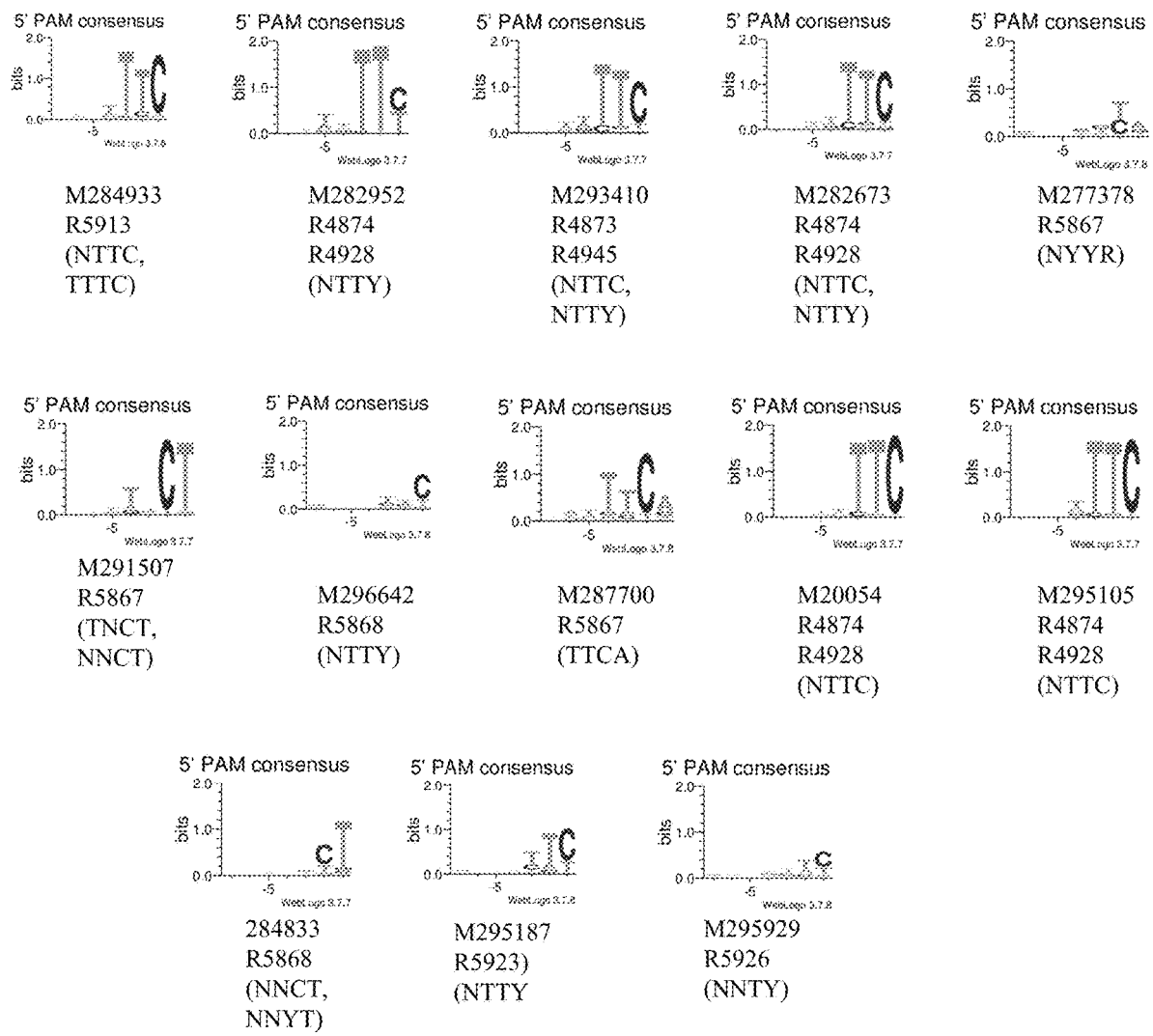

Each variant and control plasmid were incubated in reduced serum media (Opti-MEM) with equivolume of shown in TABLE 11 and TABLE 12. To demonstrate relative nuclease activity, the mean of replicate values were plotted in relation to the two target loci, as grouped by domain, and normalized to the wild type. Results can be seen in FIGS. 4-6.

TABLE 9

Exemplary Variants of CasM.19952 SEQ ID NO: 23

| Construct no. | Alteration | SEQ ID NO: |
|---|---|---|
| 1 | A110R | 241 |
| 2 | T111R | 242 |
| 3 | E112R | 243 |
| 4 | M113R | 244 |
| 5 | S114R | 245 |
| 6 | T115R | 246 |
| 7 | Q116R | 247 |
| 8 | S117R | 248 |
| 9 | L118R | 249 |
| 10 | S119R | 250 |
| 11 | F122R | 251 |
| 12 | A123R | 252 |
| 13 | T124R | 253 |
| 14 | E125R | 254 |
| 15 | L126R | 255 |
| 16 | E127R | 256 |
| 17 | T128R | 257 |
| 18 | N129R | 258 |

TABLE 9-continued

Exemplary Variants of CasM.19952 SEQ ID NO: 23

| Construct no. | Alteration | SEQ ID NO: |
|---|---|---|
| 19 | I130R | 259 |
| 20 | F131R | 260 |
| 21 | A132R | 261 |
| 22 | K261R | 262 |
| 23 | V263R | 263 |
| 24 | V264R | 264 |
| 25 | G265R | 265 |
| 26 | V266R | 266 |
| 27 | D267R | 267 |
| 28 | L268R | 268 |
| 29 | G269R | 269 |
| 30 | I270R | 270 |
| 31 | N271R | 271 |
| 32 | V272R | 272 |
| 33 | P273R | 273 |
| 34 | A274R | 274 |
| 35 | Y275R | 275 |
| 36 | V276R | 276 |
| 37 | A277R | 277 |
| 38 | T278R | 278 |
| 39 | N279R | 279 |
| 40 | I280R | 280 |
| 41 | T281R | 281 |
| 42 | E282R | 282 |
| 43 | I457R | 283 |
| 44 | A458R | 284 |
| 45 | N459R | 285 |
| 46 | S460R | 286 |
| 47 | K461R | 287 |
| 48 | D462R | 288 |
| 49 | I463R | 289 |
| 50 | I464R | 290 |
| 51 | K466R | 291 |
| 52 | N467R | 292 |
| 53 | E468R | 293 |
| 54 | wt | 23 |

TABLE 10

Target Amplicon Primers

| Target | Spacer Target | Forward | Reverse |
|---|---|---|---|
| B2M2 | GATGGATGAAA CCCAGACAC (SEQ ID NO: 294) | TCGTCGGCAGCGTCAGATG TGTATAAGAGACAGCCCA AGTGAAATACCCTGGC (SEQ ID NO: 295) | GTCTCGTGGGCTCGGAGA TGTGTATAAGAGACAGGA GTGGGGGTGAATTCAGTG (SEQ ID NO: 296) |
| B2M4 | GGCCGAGATGT CTCGCTCCG (SEQ ID NO: 297) | TCGTCGGCAGCGTCAGATG TGTATAAGAGACAGCCTCT CTCTAACCTGGCACT (SEQ ID NO: 298) | GTCTCGTGGGCTCGGAGA TGTGTATAAGAGACAGGA GGGTAGGAGAGACTCACG (SEQ ID NO: 299) |

TABLE 11

Variants of CasM.19952 (SEQ ID NO: 23) Targeting B2M2

| Construct no. | Replicate 1- Indel Percentage | Replicate 2- Indel Percentage |
|---|---|---|
| 1 | 0.0243709255 | 0.0264183343 |
| 2 | 11.80903008 | 11.55975252 |
| 3 | 0.1590562662 | 0.1213469512 |
| 4 | 3.909401179 | 4.195510803 |
| 5 | 9.633175559 | 11.74726578 |
| 6 | 11.93083574 | 13.08492201 |
| 7 | 5.841839872 | 6.696656784 |
| 8 | 0.1928358558 | 0.0889397116 |
| 9 | 1.801434152 | 3.262092239 |
| 10 | 0.0268326715 | 0.0098653381 |
| 11 | 0.070387837 | 0.0260586319 |
| 12 | 0.0272464716 | 0.0142257629 |
| 13 | 25.83235981 | 26.42070165 |
| 14 | 1.615731463 | 2.090964591 |
| 15 | 11.28852581 | 16.0710087 |
| 16 | 17.00047814 | 18.90607948 |
| 17 | 23.57286157 | 27.76788893 |
| 18 | 19.93106844 | 20.97760787 |
| 19 | 8.294062206 | 9.293997272 |
| 20 | 7.2338181 | 7.218394488 |
| 21 | 15.28013582 | 17.52549286 |
| 22 | 12.13839579 | 17.73327366 |
| 23 | 12.54012092 | 12.29857971 |
| 24 | 0 | 0.0223580265 |
| 25 | 0 | 0.0160935572 |
| 26 | 0.0260111848 | 0.0059616072 |
| 27 | 0.0316605984 | 0.0118406252 |
| 28 | 0.054542149 | 0.0343760743 |
| 29 | 0.0124633888 | 0.0119524293 |
| 30 | 0.0198124422 | 0 |
| 31 | 4.04440444 | 3.583941914 |
| 32 | 1.672555948 | 2.454394693 |
| 33 | 16.73819743 | 23.40479193 |
| 34 | 0 | 0.0056471651 |
| 35 | 0.0784481529 | 0.0056322163 |
| 36 | 0.0607964333 | 0.031375502 |
| 37 | 20.69262084 | 25.1319078 |
| 38 | 29.06575985 | 36.80249309 |
| 39 | 17.75051476 | 21.01206434 |
| 40 | 9.301425531 | 9.378700069 |
| 41 | 27.23742383 | 30.56776133 |
| 42 | 31.50726855 | 33.27960874 |
| 43 | 0.0061500615 | 0.0119581465 |
| 44 | 14.77835163 | 17.02872382 |
| 45 | 16.75675676 | 20.11758074 |
| 46 | 15.34582987 | 21.32122969 |
| 47 | 9.505341724 | 10.49826475 |
| 48 | 20.29582318 | 20.18798529 |
| 49 | 7.359531196 | 8.803426593 |
| 50 | 8.905185961 | 11.81126487 |
| 51 | 14.61948354 | 19.14845559 |
| 52 | 11.45315152 | 13.39380197 |
| 53 | 10.60639471 | 14.31117352 |
| 54 | 0.0203984497 | 0.033792346 |

TABLE 12

Variants of CasM.19952 (SEQ ID NO: 23) Targeting B2M4

| Construct no. | Replicate 1- Indel Percentage | Replicate 2- Indel Percentage |
|---|---|---|
| 1 | 0.043185352 | 0.018146625 |
| 2 | 4.133738602 | 4.038123903 |
| 3 | 0.169546262 | 0.073549077 |
| 4 | 1.873151495 | 1.722811875 |
| 5 | 2.298481933 | 2.992013351 |
| 6 | 5.513433935 | 4.681369233 |
| 7 | 2.365221987 | 2.358761113 |
| 8 | 0.07403419 | 0.015896988 |
| 9 | 0.777565328 | 0.699813759 |
| 10 | 0.029262583 | 0.007087675 |
| 11 | 0.081509082 | 0.100493331 |
| 12 | 0.017353579 | 0 |
| 13 | 5.93902898 | 8.131763208 |
| 14 | 0.861000587 | 0.706082518 |
| 15 | 4.682963379 | 6.506568145 |
| 16 | 5.439283716 | 5.788635157 |
| 17 | 8.984796469 | 12.06173461 |
| 18 | 7.740565583 | 7.89090152 |
| 19 | 2.071005917 | 2.201331767 |
| 20 | 4.907545351 | 3.173109819 |
| 21 | 3.894992153 | 4.444144266 |
| 22 | 5.706861707 | 8.00478919 |
| 23 | 5.482057219 | 5.428681276 |
| 24 | 0.132751754 | 0.042423814 |
| 25 | 0.006322311 | 0.011249859 |
| 26 | 0.139679811 | 0.037074798 |
| 27 | 0 | 0.040025616 |
| 28 | 0.173451689 | 0.349344978 |
| 29 | 0 | 0.023699491 |
| 30 | 0.016924769 | 0.020249064 |
| 31 | 0.739534568 | 0.882793411 |
| 32 | 0.333111259 | 0.610736098 |
| 33 | 0.659563673 | 1.160872875 |
| 34 | 0.029513035 | 0.019199386 |
| 35 | 0.108069164 | 0.009848336 |
| 36 | 0.012193635 | 0.009329229 |
| 37 | 0.422500207 | 0.818021646 |
| 38 | 8.529945554 | 10.53685168 |
| 39 | 2.823706249 | 3.787957842 |
| 40 | 2.182810368 | 2.912861022 |
| 41 | 6.361163423 | 9.705258539 |
| 42 | 7.744796998 | 11.33583268 |
| 43 | 0.032425422 | 0 |
| 44 | 0.075677312 | 0.194590387 |
| 45 | 4.940509915 | 6.497097042 |
| 46 | 4.612868048 | 5.634609094 |
| 47 | 2.681992337 | 4.139978128 |
| 48 | 4.959950709 | 6.668446699 |
| 49 | 4.043285785 | 4.850129028 |
| 50 | 3.731494626 | 4.326276882 |
| 51 | 5.679806919 | 7.238833071 |
| 52 | 5.537331059 | 5.336870027 |
| 53 | 6.186200959 | 6.520273524 |
| 54 | 0.0067999456 | 0.0299401198 |

Example 5: PAM Screening for D2S Effector Proteins

D2S effector proteins and guide RNA combinations were screened by in vitro enrichment (IVE) for PAM recognition. Effector proteins and guide RNAs were expressed and purified from E. coli. Briefly, effector proteins were complexed with corresponding guide RNAs for 15 minutes at 37° C. The complexes were added to an IVE reaction mix. PAM screening reactions used 10 µl of RNP in 100 µl reactions with 1,000 ng of a 5' PAM library in 1× Cutsmart buffer and were carried out for 15 minutes at 25° C., 45 minutes at 37° C. and 15 minutes at 45° C. Reactions were terminated with 1 µl of proteinase K and 5 µl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 13) generally had lower signal due to more noise than the 1% (PAM 1% in TABLE 13). In some cases the 1% enrichment met the cutoff criteria, but the 5% enrichment did not. In such cases, a PAM is included for the 1% enrichment, but not the 5% enrichment. Complexes (e.g., the composition) and corresponding identified PAMs are provided in TABLE 13. Additionally, TABLE 13 also shows the effector protein Seq ID NO (under Enzyme Seq ID NO), and the cr/sgRNA designation number, tracr RNA designation number, and their corresponding sequences if applicable. Additionally, FIGS. 7A-7E illustrate PAM preferences for the different D2S effector proteins used in this example. As shown in TABLE 13, the IVE assay revealed the presence of enriched 5' PAM consensus sequences for the various D2S effector proteins.

TABLE 13

Compositions for D2S effector protein PAM screening

| Comp. Enzyme Seq ID NO. | PAM_1 % | PAM_5 % | cr/sgRNA # cr/sgRNA Seq ID NO. | cr/sgRNA | tracrRNA # tracrRNA Seq ID NO. |
|---|---|---|---|---|---|
| PL3314, 33 | NNNKNTK (SEQ ID NO: 310) | NNNNNTN (SEQ ID NO: 319) | R4882 (SEQ ID NO: 151) | sgRNA | |
| PL3314, 33 | NNNKNTT (SEQ ID NO: 311) | NNNNNTN (SEQ ID NO: 319) | R4887 (SEQ ID NO: 150) | SgRNA | |
| PL3318, R5946 8 | NNNNTTC (SEQ ID NO: 331) | NNNNTNN (SEQ ID NO: 329) | R4845 (SEQ ID NO: 53) | crRNA | R5946 (Seq ID NO: 372) |
| PL3318, 8 | NNNNYTN (SEQ ID NO: 338) | NNNNTYN (SEQ ID NO: 335) | R5938 (SEQ ID NO: 373) | sgRNA | |
| PL3411, R4945 36 | NNNNTTC (SEQ ID NO: 331) | NNNNTTN (SEQ ID NO: 332) | R4873 (SEQ ID NO: 89) | crRNA | R4945 (SEQ ID NO: 145) |

TABLE 13-continued

Compositions for D2S effector protein PAM screening

| Comp. Enzyme Seq ID NO. | PAM_1 % | PAM_5 % | cr/sgRNA # cr/sgRNA Seq ID NO. | cr/sgRNA | tracrRNA # tracrRNA Seq ID NO. |
|---|---|---|---|---|---|
| PL3411, R4874, R4928 36 | NNNNTTC (SEQ ID NO: 331) | NNNNTTY (SEQ ID NO: 333) | R4874 (SEQ ID NO: 90) | crRNA | R4928 (SEQ ID NO: 147) |
| PL3411, R5867 36 | NNNTTCN (SEQ ID NO: 351) | NNNTTYN (SEQ ID NO: 354) | R5867 (SEQ ID NO: 374) | sgRNA | |
| PL3411, R5868 36 | NNNNTTC (SEQ ID NO: 331) | NNNNTTY (SEQ ID NO: 333) | R5868 (SEQ ID NO: 375) | sgRNA | |
| PL3411, R5925 36 | NNNNTTC (SEQ ID NO: 331) | NNNNTTY (SEQ ID NO: 333) | R5925 (SEQ ID NO: 376) | sgRNA | |
| PL3412, R4874, R4928 37 | NNNNTTY (SEQ ID NO: 333) | NNNNYTY (SEQ ID NO: 339) | R4874 (SEQ ID NO: 90) | crRNA | R4928 (SEQ ID NO: 147) |
| PL3412, R5925 37 | NNNNNTY (SEQ ID NO: 320) | NNNNNTY (SEQ ID NO: 320) | R5925 (SEQ ID NO: 376) | sgRNA | |
| PL3412, R5933 37 | NNNNTTY (SEQ ID NO: 333) | NNNNYTY (SEQ ID NO: 339) | R5933 (SEQ ID NO: 377) | sgRNA | |
| PL3413, R4873, R4945 38 | NNNNTTC (SEQ ID NO: 331) | NNNNTTC (SEQ ID NO: 331) | R4873 (SEQ ID NO: 89) | crRNA | R4945 (SEQ ID NO: 145) |
| PL3413, R4874, R4928 38 | NNNNTTC (SEQ ID NO: 331) | NNNNTTC (SEQ ID NO: 331) | R4874 (SEQ ID NO: 90) | crRNA | R4928 (SEQ ID NO: 147) |
| PL3413, R5867 38 | NNNTTCN (SEQ ID NO: 351) | NNNTTCN (SEQ ID NO: 351) | R5867 (SEQ ID NO: 374) | sgRNA | |
| PL3413, R5868 38 | NNNNTTC (SEQ ID NO: 331) | NNNNTTY (SEQ ID NO: 333) | R5868 (SEQ ID NO: 375) | sgRNA | |
| PL3413, R5925 38 | NNNNTTC (SEQ ID NO: 331) | NNNNTTC (SEQ ID NO: 331) | R5925 (SEQ ID NO: 376) | sgRNA | |
| PL3413, R5931 38 | NNNNTTC (SEQ ID NO: 331) | NNNNTTC (SEQ ID NO: 331) | R5931 (SEQ ID NO: 378) | sgRNA | |
| PL3413, R5932 38 | NNNNTTC (SEQ ID NO: 331) | NNNNTNY (SEQ ID NO: 330) | R5932 (SEQ ID NO: 379) | sgRNA | |
| PL3414, R4873, R4945 39 | NNNTYCT (SEQ ID NO: 355) | NNNNNCT (SEQ ID NO: 317) | R4873 (SEQ ID NO: 89) | crRNA | R4945 (SEQ ID NO: 145) |
| PL3414, R5867 39 | NNNNTYN (SEQ ID NO: 335) | NNNNNYN (SEQ ID NO: 321) | R5867 (SEQ ID NO: 374) | sgRNA | |
| PL3414, R5868 39 | NNNNNNT (SEQ ID NO: 302) | NNNNNYT (SEQ ID NO: 323) | R5868 (SEQ ID NO: 375) | sgRNA | |
| PL3414, R5925 39 | NNNNNYT (SEQ ID NO: 323) | NNNNNYT (SEQ ID NO: 323) | R5925 (SEQ ID NO: 376) | sgRNA | |
| PL3414, R5929 39 | NNNCTTN (SEQ ID NO: 306) | | R5929 (SEQ ID NO: 380) | sgRNA | |
| PL3414, R5930 39 | NNNTYYT (SEQ ID NO: 359) | NNNNNYT (SEQ ID NO: 323) | R5930 (SEQ ID NO: 381) | sgRNA | |
| PL3415, R5867 40 | NNNNNYN (SEQ ID NO: 321) | NNNNNYN (SEQ ID NO: 321) | R5867 (SEQ ID NO: 374) | sgRNA | |
| PL3416, R4873, R4945 41 | NNNNNYT (SEQ ID NO: 323) | NNNNNNT (SEQ ID NO: 302) | R4873 (SEQ ID NO: 89) | crRNA | R4945 (SEQ ID NO: 145) |

TABLE 13-continued

Compositions for D2S effector protein PAM screening

| Comp. Enzyme Seq ID NO. | PAM_1 % | PAM_5 % | cr/sgRNA # cr/sgRNA Seq ID NO. | cr/sgRNA | tracrRNA # tracrRNA Seq ID NO. |
|---|---|---|---|---|---|
| PL3416, R4874, R4928 41 | NNNNNYT (SEQ ID NO: 323) | NNNNNNT (SEQ ID NO: 302) | R4874 (SEQ ID NO: 90) | crRNA | R4928 (SEQ ID NO: 147) |
| PL3416, R5867 41 | NNNWNCT (SEQ ID NO: 358) | NNNNNCT (SEQ ID NO: 317) | R5867 (SEQ ID NO: 374) | sgRNA | |
| PL3417, R4873, R4945 42 | NNNNTTC (SEQ ID NO: 331) | NNNNTTY (SEQ ID NO: 333) | R4873 (SEQ ID NO: 89) | crRNA | R4945 (SEQ ID NO: 145) |
| PL3417, R4874, R4928 42 | NNNNTTC (SEQ ID NO: 331) | NNNNTTY (SEQ ID NO: 333) | R4874 (SEQ ID NO: 90) | crRNA | R4928 (SEQ ID NO: 147) |
| PL3417, R5867 42 | NNNTTTN (SEQ ID NO: 353) | NNTTYN (SEQ ID NO: 354) | R5867 (SEQ ID NO: 374) | sgRNA | |
| PL3417, R5868 42 | NNNTYYW (SEQ ID NO: 357) | NNNNTYN (SEQ ID NO: 335) | R5868 (SEQ ID NO: 375) | sgRNA | |
| PL3417, R5925 42 | NNNTYYN (SEQ ID NO: 356) | NNNNTTY (SEQ ID NO: 333) | R5925 (SEQ ID NO: 376) | sgRNA | |
| PL3418, R4873, R4945 43 | NNNNTTC (SEQ ID NO: 331) | NNNNTTC (SEQ ID NO: 331) | R4873 (SEQ ID NO: 89) | crRNA | R4945 (SEQ ID NO: 145) |
| PL3418, R4874, R4928 43 | NNNNTTC (SEQ ID NO: 331) | NNNNTTC (SEQ ID NO: 331) | R4874 (SEQ ID NO: 90) | crRNA | R4928 (SEQ ID NO: 147) |
| PL3418, R5867 43 | NNNTTCN (SEQ ID NO: 351) | NNNTTCN (SEQ ID NO: 351) | R5867 (SEQ ID NO: 374) | sgRNA | |
| PL3418, R5868 43 | NNNNTTC (SEQ ID NO: 331) | NNNNTTC (SEQ ID NO: 331) | R5868 (SEQ ID NO: 375) | sgRNA | |
| PL3418, R5925 43 | NNNNTTC (SEQ ID NO: 331) | NNNNTTC (SEQ ID NO: 331) | R5925 (SEQ ID NO: 376) | sgRNA | |
| PL4976, R5800 203 | NNNNCCR (SEQ ID NO: 313) | NNNNCCN (SEQ ID NO: 312) | R5800 (SEQ ID NO: 382) | sgRNA | |
| PL4977, R5726, R5783 209 | NNNNCCN (SEQ ID NO: 312) | NNNNCCN (SEQ ID NO: 312) | R5726 (SEQ ID NO: 383) | crRNA | R5783 (SEQ ID NO: 384) |
| PL4977, R5799 209 | NNNNCCN (SEQ ID NO: 312) | NNNNCCN (SEQ ID NO: 312) | R5799 (SEQ ID NO: 385) | sgRNA | |
| PL4977, R5800 209 | NNNNCCN (SEQ ID NO: 312) | NNNNCCN (SEQ ID NO: 312) | R5800 (SEQ ID NO: 382) | sgRNA | |
| PL4977, R5801 209 | NNNNCCR (SEQ ID NO: 313) | NNNNCCN (SEQ ID NO: 312) | R5801 (SEQ ID NO: 386) | sgRNA | |
| PL4977, R5802 209 | NNNNCCN (SEQ ID NO: 312) | NNNNCCN (SEQ ID NO: 312) | R5802 (SEQ ID NO: 387) | sgRNA | |
| PL3302, R5913 4 | | | R5913 (SEQ ID NO: 388) | sgRNA | |
| PL3302, R5914 4 | | | R5914 (SEQ ID NO: 389) | sgRNA | |
| PL3306, R5935 5 | NNNNTNN (SEQ ID NO: 329) | | R5935 (SEQ ID NO: 390) | sgRNA | |
| PL3306, R5936 5 | NNNNTTY (SEQ ID NO: 333) | NNNNTYC (SEQ ID NO: 334) | R5936 (SEQ ID NO: 391) | sgRNA | |

TABLE 13-continued

Compositions for D2S effector protein PAM screening

| Comp. Enzyme Seq ID NO. | PAM_1 % | PAM_5 % | cr/sgRNA # cr/sgRNA Seq ID NO. | cr/sgRNA | tracrRNA # tracrRNA Seq ID NO. |
|---|---|---|---|---|---|
| PL3310, R5959 28 | | | R5959 (SEQ ID NO: 392) | sgRNA | |
| PL3310, R5960 28 | | | R5960 (SEQ ID NO: 393) | sgRNA | |
| PL3310, R5961 28 | | | R5961 (SEQ ID NO: 394) | sgRNA | |
| PL3310, R5962 28 | | | R5962 (SEQ ID NO: 395) | sgRNA | |
| PL3310, R5963 28 | | | R5963 (SEQ ID NO: 396) | sgRNA | |
| PL3310, R5964 28 | | | R5964 (SEQ ID NO: 397) | sgRNA | |
| PL3310, R5965 28 | | | R5965 (SEQ ID NO: 398) | sgRNA | |
| PL3310, R5977 28 | | | R5977 (SEQ ID NO: 399) | sgRNA | |
| PL3310, R5978 28 | | | R5978 (SEQ ID NO: 400) | sgRNA | |
| PL3310, R5979 28 | | | R5979 (SEQ ID NO: 401) | sgRNA | |
| PL3310, R5980 28 | | | R5980 (SEQ ID NO: 402) | sgRNA | |
| PL3319, R4846, R5947 9 | NNNGNNN (SEQ ID NO: 307) | | R4846 (SEQ ID NO: 54) | crRNA | R5947 (SEQ ID NO: 403) |
| PL3327, R4879, R4935 1 | NNNNCTT (SEQ ID NO: 314) | NNNNNTT (SEQ ID NO: 404) | R4879 (SEQ ID NO: 405) | crRNA | R4935 (SEQ ID NO: 91) |
| PL3327, R5911 1 | | | R5911 (SEQ ID NO: 406) | sgRNA | |
| PL3327, R5912 1 | | | R5912 (SEQ ID NO: 407) | sgRNA | |
| PL3410, R4873, R4945 35 | NNNNTTC (SEQ ID NO: 331) | NNNNYTC (SEQ ID NO: 337) | R4873 (SEQ ID NO: 89) | crRNA | R4945 (SEQ ID NO: 145) |
| PL3410, R4874, R4928 35 | NNNNTTC (SEQ ID NO: 331) | NNNNYWC (SEQ ID NO: 340) | R4874 (SEQ ID NO: 90) | crRNA | R4928 (SEQ ID NO: 147) |
| PL3410, R5867 35 | NNNNTTC (SEQ ID NO: 331) | NNNTNYN (SEQ ID NO: 350) | R5867 (SEQ ID NO: 374) | sgRNA | |
| PL3419, R4873, R4945 44 | | | R4873 (SEQ ID NO: 89) | crRNA | R4945 (SEQ ID NO: 145) |
| PL3419, R5923 44 | | | R5923 (SEQ ID NO: 408) | sgRNA | |
| PL3419, R5924 44 | | | R5924 (SEQ ID NO: 409) | sgRNA | |
| PL3420, R5925 45 | | | R5925 (SEQ ID NO: 376) | sgRNA | |
| PL3420, R5926 45 | | | R5926 (SEQ ID NO: 410) | sgRNA | |

TABLE 13-continued

Compositions for D2S effector protein PAM screening

| Comp. Enzyme Seq ID NO. | PAM_1 % | PAM_5 % | cr/sgRNA # cr/sgRNA Seq ID NO. | cr/sgRNA | tracrRNA # tracrRNA Seq ID NO. |
|---|---|---|---|---|---|
| PL3420, R5927 45 | | | R5927 (SEQ ID NO: 411) | sgRNA | |
| PL3420, R5928 45 | | | R5928 (SEQ ID NO: 412) | sgRNA | |
| PL3414, R4873, R4945 39 | NNNTYCT (SEQ ID NO: 355) | NNNNNCT (SEQ ID NO: 317) | R4873 (SEQ ID NO: 89) | crRNA | R4945 (SEQ ID NO: 145) |
| PL3414, R5867 39 | NNNNTYN (SEQ ID NO: 335) | NNNNNYN (SEQ ID NO: 321) | R5867 (SEQ ID NO: 374) | sgRNA | |
| PL3414, R5868 39 | NNNNNNT (SEQ ID NO: 302) | NNNNNYT (SEQ ID NO: 323) | R5868 (SEQ ID NO: 375) | sgRNA | |
| PL3414, R5925 39 | NNNNNYT (SEQ ID NO: 323) | NNNNNYT (SEQ ID NO: 323) | R5925 (SEQ ID NO: 376) | sgRNA | |
| PL3414, R5929 39 | NNNCTTN (SEQ ID NO: 306) | NNNCTTN (SEQ ID NO: 306) | R5929 (SEQ ID NO: 380) | sgRNA | |
| PL3414, R5930 39 | NNNTYYT (SEQ ID NO: 359) | NNNNNYT (SEQ ID NO: 323) | R5930 (SEQ ID NO: 381) | sgRNA | |
| PL3327, R4879, R4935 1 | NNNNCTT (SEQ ID NO: 314) | NNNNNTT (SEQ ID NO: 404) | R4879 (SEQ ID NO: 405) | crRNA | R4935 (SEQ ID NO: 91) |

Example 6: PAM Screening for D2S Effector Proteins

D2S effector proteins and guide RNA combinations were screened by in vitro enrichment (IVE) for PAM recognition. Effector proteins and guide RNAs were expressed and purified from E. coli. Briefly, effector proteins were complexed with corresponding guide RNAs for 15 minutes at 37° C. The complexes were added to an IVE reaction mix. PAM screening reactions used 10 μl of RNP in 100 μl reactions with 1,000 ng of a 5' PAM library in 1× Cutsmart buffer and were carried out for 15 minutes at 25° C., 45 minutes at 37° C. and 15 minutes at 45° C. Reactions were terminated with 1 μl of proteinase K and 5 μl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 14) generally had lower signal due to more noise than the 1% (PAM 1% in TABLE 14). In some cases, the 1% enrichment met the cutoff criteria, but the 5% enrichment did not. In such cases, a PAM is included for the 1% enrichment, but not the 5% enrichment. Complexes (e.g., the composition) and corresponding identified PAMs are provided in TABLE 14. Additionally, TABLE 14 also shows the effector protein Seq ID NO (under Enzyme Seq ID NO), and the cr/sgRNA designation number, tracr RNA designation number, and their corresponding sequences if applicable. FIGS. 7A-7E illustrate PAM preferences for the different D2S effector proteins used in this example. As shown in TABLE 14, the IVE assay revealed the presence of enriched 5' PAM consensus sequences for the various D2S effector proteins.

TABLE 14

Compositions or D2S effector protein PAM screening

| Comp. Enzyme Seq ID NO. | PAM_1 % | PAM_5 % | cr/sgRNA # cr/sgRNA Seq ID NO. | cr/sgRNA | tracrRNA# tracrRNA Seq ID NO. |
|---|---|---|---|---|---|
| PL4967, R5727, R5786 204 | NNWTTYN (SEQ ID NO: 366) | NNNNTYN (SEQ ID NO: 335) | R5727 (SEQ ID NO: 413) | crRNA | R5786 (SEQ ID NO: 414) |
| PL4968, R5728, R5788 212 | NNNTTTN (SEQ ID NO: 353) | NNNNTTN (SEQ ID NO: 332) | R5728 (SEQ ID NO: 415) | crRNA | R5788 (SEQ ID NO: 416) |
| PL4970, R5730, R5791 232 | NNWWTTN (SEQ ID NO: 367) | | R5730 (SEQ ID NO: 417) | crRNA | R5791 (SEQ ID NO: 418) |

TABLE 14-continued

Compositions or D2S effector protein PAM screening

| Comp. Enzyme Seq ID NO. | PAM_1 % | PAM_5 % | cr/sgRNA # cr/sgRNA Seq ID NO. | cr/sgRNA | tracrRNA# tracrRNA Seq ID NO. |
|---|---|---|---|---|---|
| PL4970, R5730, R5792 232 | NNTTTYN (SEQ ID NO: 365) | NNNNTYN (SEQ ID NO: 335) | R5730 (SEQ ID NO: 417) | crRNA | R5792 (SEQ ID NO: 419) |
| PL4980, R5691, R5814 218 | NRNNNNN (SEQ ID NO: 303) | | R5691 (SEQ ID NO: 420) | crRNA | R5814 (SEQ ID NO: 421) |
| PL4988, R5697, R5831 206 | NNNNNNG (SEQ ID NO: 301) | | R5697 (SEQ ID NO: 422) | crRNA | R5831 (SEQ ID NO: 423) |
| PL4988, R5697, R5847 206 | NNNTNTG (SEQ ID NO: 349) | NNNNNTG (SEQ ID NO: 318) | R5697 (SEQ ID NO: 422) | crRNA | R5847 (SEQ ID NO: 424) |
| PL4988, R5869 206 | NNNTNTG (SEQ ID NO: 349) | NNNNNTG (SEQ ID NO: 318) | R5869 (SEQ ID NO: 425) | sgRNA | |
| PL4988, R5873 206 | NNNTNTG (SEQ ID NO: 349) | NNNNNTG (SEQ ID NO: 318) | R5873 (SEQ ID NO: 426) | sgRNA | |
| PL4989, R5698, R5832 221 | NNNWNTG (SEQ ID NO: 360) | NNNNNTG (SEQ ID NO: 318) | R5698 (SEQ ID NO: 427) | crRNA | R5832 (SEQ ID NO: 428) |
| PL4989, R5698, R5848 221 | NNNWNTG (SEQ ID NO: 360) | NNNNNTG (SEQ ID NO: 318) | R5698 (SEQ ID NO: 427) | crRNA | R5848 (SEQ ID NO: 429) |
| PL4990, R5699, R5833 228 | NNNTNTG (SEQ ID NO: 349) | NNNNNYR (SEQ ID NO: 322) | R5699 (SEQ ID NO: 430) | crRNA | R5833 (SEQ ID NO: 431) |
| PL4990, R5699, R5849 228 | NNNWYTG (SEQ ID NO: 361) | NNNNNTG (SEQ ID NO: 318) | R5699 (SEQ ID NO: 430) | crRNA | R5833 (SEQ ID NO: 431) |
| PL4990, R5699 228 | NNNWNTG (SEQ ID NO: 360) | NNNNNTG (SEQ ID NO: 318) | R5699 (SEQ ID NO: 430) | crRNA | R5849 (SEQ ID NO: 432) |
| PL4990, R5870 228 | NNNWYTG (SEQ ID NO: 361) | NNNNNTG (SEQ ID NO: 318) | R5870 (SEQ ID NO: 433) | sgRNA | |
| PL4990, R5874 228 | NNNWYTG (SEQ ID NO: 361) | NNNNNTG (SEQ ID NO: 318) | R5874 (SEQ ID NO: 434) | sgRNA | |
| PL4991, R5700, R5834 233 | NNNTNTG (SEQ ID NO: 349) | NNNNNTG (SEQ ID NO: 318) | R5700 (SEQ ID NO: 435) | crRNA | R5834 (SEQ ID NO: 436) |
| PL4991, R5700, R5850 233 | NNNWNTG (SEQ ID NO: 360) | NNNNNTG (SEQ ID NO: 318) | R5700 (SEQ ID NO: 435) | crRNA | R5850 (SEQ ID NO: 437) |
| PL4992, R5702, R5846 240 | NNNRTRG (SEQ ID NO: 343) | NNNNNNG (SEQ ID NO: 301) | R5702 (SEQ ID NO: 438) | crRNA | R5846 (SEQ ID NO: 439) |
| PL4992, R5702, R5861 240 | NNNRTRG (SEQ ID NO: 343) | NNNNNNG (SEQ ID NO: 301) | R5702 (SEQ ID NO: 438) | crRNA | R5861 (SEQ ID NO: 440) |
| PL4994, R5835 202 | NNKRTTN (SEQ ID NO: 305) | NNNNTTN (SEQ ID NO: 332) | R5835 (SEQ ID NO: 441) | sgRNA | |
| PL4994, R5851 202 | NNKRTTN (SEQ ID NO: 305) | | R5851 (SEQ ID NO: 442) | sgRNA | |
| PL4995, R5836 205 | NNNRTTN (SEQ ID NO: 345) | NNNRTTN (SEQ ID NO: 345) | R5836 (SEQ ID NO: 443) | sgRNA | |
| PL4995, R5852 205 | NNNRTTN (SEQ ID NO: 345) | NNNRTTN (SEQ ID NO: 345) | R5852 (SEQ ID NO: 444) | sgRNA | |

TABLE 14-continued

Compositions or D2S effector protein PAM screening

| Comp. Enzyme Seq ID NO. | PAM_1 % | PAM_5 % | cr/sgRNA # cr/sgRNA Seq ID NO. | cr/sgRNA | tracrRNA# tracrRNA Seq ID NO. |
|---|---|---|---|---|---|
| PL4997, R5838 208 | NNNRTWG (SEQ ID NO: 346) | NNNRTTG (SEQ ID NO: 344) | R5838 (SEQ ID NO: 445) | sgRNA | |
| PL4997, R5854 208 | NNNRTWG (SEQ ID NO: 346) | NNNRTTG (SEQ ID NO: 344) | R5854 (SEQ ID NO: 446) | sgRNA | |
| PL4998, R5871 213 | NNRGTYG (SEQ ID NO: 363) | NNNGTYN (SEQ ID NO: 309) | R5871 (SEQ ID NO: 447) | sgRNA | |
| PL4998, R5876 213 | NNNGTYG (SEQ ID NO: 308) | NNNGTYN (SEQ ID NO: 309) | R5876 (SEQ ID NO: 448) | sgRNA | |
| PL4999, R5840 216 | NNNRTNG (SEQ ID NO: 342) | NNNRNNG (SEQ ID NO: 341) | R5840 (SEQ ID NO: 449) | sgRNA | |
| PL4999, R5855 216 | NNNRTNG (SEQ ID NO: 342) | NNNRNNG (SEQ ID NO: 341) | R5855 (SEQ ID NO: 450) | sgRNA | |
| PL5000, R5841 217 | NNNRTTN (SEQ ID NO: 345) | NNNRTTN (SEQ ID NO: 345) | R5841 (SEQ ID NO: 451) | sgRNA | |
| PL5000, R5856 217 | NNNRTTN (SEQ ID NO: 345) | NNNRTTN (SEQ ID NO: 345) | R5856 (SEQ ID NO: 452) | sgRNA | |
| PL5001, R5842 220 | NNNTNCG (SEQ ID NO: 348) | NNNNNCG (SEQ ID NO: 316) | R5842 (SEQ ID NO: 453) | sgRNA | |
| PL5001, R5842 220 | NNNTKCG (SEQ ID NO: 347) | NNNNNCG (SEQ ID NO: 316) | R5842 (SEQ ID NO: 453) | sgRNA | |
| PL5001, R5857 220 | NNNTKCG (SEQ ID NO: 347) | NNNNNCG (SEQ ID NO: 316) | R5857 (SEQ ID NO: 454) | sgRNA | |
| PL5002, R5843 225 | NNNRTRG (SEQ ID NO: 343) | | R5843 (SEQ ID NO: 455) | sgRNA | |
| PL5002, R5858 225 | NNNRTRG (SEQ ID NO: 343) | NNNNNNG (SEQ ID NO: 301) | R5858 (SEQ ID NO: 456) | sgRNA | |
| PL5003, R5844 229 | NNNNTCG (SEQ ID NO: 325) | NNNNNCG (SEQ ID NO: 316) | R5844 (SEQ ID NO: 457) | sgRNA | |
| PL5003, R5859 229 | NNNNTCG (SEQ ID NO: 325) | NNNNNCG (SEQ ID NO: 316) | R5859 (SEQ ID NO: 458) | sgRNA | |
| PL5004, R5683, R5807 210 | NNNYTTR (SEQ ID NO: 362) | NNNNTYR (SEQ ID NO: 336) | R5683 (SEQ ID NO: 459) | crRNA | R5807 (SEQ ID NO: 460) |
| PL5004, R5867 210 | NNNTTYN (SEQ ID NO: 354) | NNNNNYN (SEQ ID NO: 321) | R5867 (SEQ ID NO: 374) | sgRNA | |
| PL5005, R5684, R5808 234 | NNNNTTC (SEQ ID NO: 331) | | R5684 (SEQ ID NO: 461) | crRNA | R5808 (SEQ ID NO: 462) |
| PL5005, R5868 234 | NNNTTNY (SEQ ID NO: 352) | NNNTTNY (SEQ ID NO: 352) | R5868 (SEQ ID NO: 375) | sgRNA | |
| PL3302, R5913 4 | NNNNTTC (SEQ ID NO: 331) | NNNNTTC (SEQ ID NO: 331) | R5913 (SEQ ID NO: 388) | sgRNA | |
| PL3302, R5913 4 | NNNNTTC (SEQ ID NO: 331) | NNNNTTC (SEQ ID NO: 331) | R5913 (SEQ ID NO: 388) | sgRNA | |
| PL3420, R5926 45 | NNNNNTY (SEQ ID NO: 320) | NNNNTTY (SEQ ID NO: 333) | R5926 (SEQ ID NO: 411) | sgRNA | |

Example 7: DETECTR Activity of D2S Effector Proteins

D2S effector proteins were tested for trans cleavage. Briefly, partially purified (nickel-NTA purified) D2S effector proteins were incubated with crRNA and tracrRNA or sgRNAs in a trans cleavage buffer (20 mM Tricine, 15 mM MgCl2, 0.2 mg/ml BSA, 1 mM TCEP (pH 9 at 37° C.) at room temperature for 20 minutes, followed by addition of target nucleic acid at a final concentration of 10 nM to produce effector-protein guide complexes. The components of the effector-protein guide complexes that were assayed are provided in TABLE 15, which shows the composition of each experiment, the effector Enzyme SEQ ID NO, and the cr/sgRNA designation number, tracr RNA designation number, and their corresponding sequences if applicable. Trans cleavage activity was detected by fluorescence signal upon cleavage of a fluorophore-quencher reporter (200 nM) in a DETECTR reaction, fluorescence activity is shown under FC max rate in TABLE 15, which indicates the maximum rate of fluorescence generated over the course of the DETECTR reaction. Dilutions were of the effector-protein guide complexes were performed, and the assay repeated at 1%, 0.1% or 0.01% of the original protein concentration. The dilution that provided the highest signal ratio is listed in TABLE 15.

TABLE 15

Compositions for D2S effector protein PAM screening

| Composition | FC max rate | P value | Enzyme Seq ID NO | cr/sgRNA sequence | cr/sgRNA | tracrRNA sequence |
|---|---|---|---|---|---|---|
| PL5006, R5804 | 2 | 0.025 | 223 | R5804 (SEQ ID NO: 463) | sgRNA | |
| PL5007, R5705, R5875 | 2.5 | 0.016 | 224 | R5705 (SEQ ID NO: 464) | crRNA | R5875 (SEQ ID NO: 465) |
| PL5022, R5772 | 2.24 | 0.040 | 214 | R5772 (SEQ ID NO: 466) | sgRNA | |

Example 8: D2S Enzyme Edit Genomic DNA in Mammalian Cells

D2S effectors were tested for their ability to produce indels in HEK293T cells. Briefly, 150 ng nuclease and 150 ng gRNA carrying plasmids were delivered by lipofection to HEK293T cells in 96 well plates. TransIT-293 reagent was diluted with warmed up OPTIMEM and mixed with the plasmid DNA at the ratio of 2:1 lipid:DNA. Lipid:DNA mixture were incubated for 10 minutes at room temperature before adding 20 µL of the lipid:DNA optimem mixture to each well. Cells were incubated for 3 days before being lysed and subjected to PCR amplification. TABLE 16 shows the constructs (e.g., composition) test and their indel percent in HEK293T cells. Additionally, TABLE 16 also shows the PAM 1% enrichment sequence, the effector protein Seq ID NO (under Enzyme Seq ID NO), and the sgRNA sequence if applicable.

Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" included as negative respectively. TABLE 16 shows the results of this experiment. The results in TABLE 16 show the D2S enzymes had nuclease activity.

TABLE 16

Indels by D2S effectors

| Composition Enzyme SEQ ID NO: | PAM 1% | Indel percent | sgRNA SEQ ID NO: |
|---|---|---|---|
| PL5614, PL6521 202 | NTCG (SEQ ID NO: 369) | 0.11 | SEQ ID NO: 180 |
| PL5614, PL6522 202 | RTTR (SEQ ID NO: 370) | 0.14 | SEQ ID NO: 467 |
| PL5616, PL6522 208 | RTTR (SEQ ID NO: 370) | 0.74 | SEQ ID NO: 467 |

TABLE 16-continued

Indels by D2S effectors

| Composition Enzyme SEQ ID NO: | PAM 1% | Indel percent | sgRNA SEQ ID NO: |
|---|---|---|---|
| PL5618, PL6522 25 | RTTR (SEQ ID NO: 370) | 1.70 | SEQ ID NO: 467 |
| PL5619, PL6522 28 | RTTR (SEQ ID NO: 370) | 5.09 | SEQ ID NO: 467 |
| PL5620, PL6522 217 | RTTR (SEQ ID NO: 370) | 0.46 | SEQ ID NO: 467 |
| PL5621, PL6522 219 | RTTR (SEQ ID NO: 370) | 3.89 | SEQ ID NO: 467 |
| PL5622, PL6521 236 | NTCG (SEQ ID NO: 369) | 1.58 | SEQ ID NO: 180 |
| PL5622, PL6522 236 | RTTR (SEQ ID NO: 370) | 1.36 | SEQ ID NO: 467 |
| PL5623, PL6522 237 | RTTR (SEQ ID NO: 370) | 1.04 | SEQ ID NO: 467 |
| PL5624, PL6522 29 | RTTR (SEQ ID NO: 370) | 0.13 | SEQ ID NO: 467 |
| PL5625, PL6521 30 | NTCG (SEQ ID NO: 369) | 0.33 | SEQ ID NO: 180 |
| PL5627, PL6521 32 | NTCG (SEQ ID NO: 369) | 0.86 | SEQ ID NO: 180 |

Example 9: D2S Enzyme Edit Genomic DNA in Mammalian Cells

Enzymes were tested for their ability to produce indels in HEK293T cells. Briefly, plasmids encoding the enzymes and guide RNAs were delivered by lipofection to HEK293T cells. Cells were incubated for approximately 48 hours before being lysed. Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" and SpyCas9 were included as negative and positive controls, respectively. TABLE 17 describes the sequences of the single guide RNAs tested and percent of reads with indels. Additionally, TABLE 17 shows the compositions tested, the PAM 1% enrichment sequence, the effector protein Seq ID NO (under Enzyme Seq ID NO), and the sgRNA sequence if applicable. The results in TABLE 17 show the D2S enzymes had nuclease activity.

TABLE 17

Indels by D2S effectors

| Comp. Enzyme SEQ ID NO: | PAM 1% | Indel percent | sgRNA SEQ ID NO: |
|---|---|---|---|
| PL5995 228 | TNTG (SEQ ID NO: 368) | 21.36 | SEQ ID NO: 468 |
| PL7302 238 | NTCG (SEQ ID NO: 369) | 7.90 | SEQ ID NO: 469 |
| PL7319 238 | NTCG (SEQ ID NO: 369) | 6.94 | SEQ ID NO: 470 |
| PL7303 238 | NTCG (SEQ ID NO: 369) | 1.44 | SEQ ID NO: 471 |
| PL7309 238 | NTCG (SEQ ID NO: 369) | 1.37 | SEQ ID NO: 472 |
| PL6239 45 | NTTC (SEQ ID NO: 371) | 1.43 | SEQ ID NO: 473 |

TABLE 17-continued

Indels by D2S effectors

| Comp. Enzyme SEQ ID NO: | PAM 1% | Indel percent | sgRNA SEQ ID NO: |
|---|---|---|---|
| PL6246 45 | NTTC (SEQ ID NO: 371) | 0.90 | SEQ ID NO: 473 |
| PL6243 45 | NTTC (SEQ ID NO: 371) | 0.29 | SEQ ID NO: 474 |
| PL6237 45 | NTTC (SEQ ID NO: 371) | 0.21 | SEQ ID NO: 475 |
| PL7375 30 | RTTR (SEQ ID NO: 370) | 0.70 | SEQ ID NO: 476 |
| PL6412 38 | NTTC (SEQ ID NO: 371) | 0.95 | SEQ ID NO: 477 |
| PL6414 38 | NTTC (SEQ ID NO: 371) | 0.70 | SEQ ID NO: 478 |
| PL6417 38 | NTTC (SEQ ID NO: 371) | 0.13 | SEQ ID NO: 479 |
| PL7399 229 | RTTR (SEQ ID NO: 370) | 0.70 | SEQ ID NO: 476 |
| PL7420 229 | RTTR (SEQ ID NO: 370) | 0.60 | SEQ ID NO: 480 |
| PL7328 222 | RTTR (SEQ ID NO: 370) | 0.69 | SEQ ID NO: 481 |

Example 10: CasM19952 Edits Genomic DNA in Mammalian Cells with Multiple sgRNA D2S effectors were tested for their ability to produce indels in HEK293T cells. Briefly, 150 ng nuclease and 150 ng gRNA carrying plasmids were delivered by lipofection to HEK293T cells in 96 well plates. TransIT-293 reagent was diluted with warmed up OPTIMEM and mixed with the plasmid DNA at the ratio of 2:1 lipid:DNA. Lipid:DNA mixture were incubated for 10 minutes at room temperature before adding 20 μL of the lipid:DNA optimem mixture to each well. Cells were incubated for 3 days before being lysed and subjected to PCR amplification. TABLE 18 shows the constructs (e.g., composition) test and their indel percent in HEK293T cells. Additionally, TABLE 18 also shows the effector protein Seq ID NO (under Enzyme Seq ID NO), and the sgRNA sequence if applicable. The PAM 1% enrichment sequence for this experiment was NTCG (SEQ ID NO: 369).

Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" and SpyCas9 were included as negative and positive controls, respectively. TABLE 18 shows the results of this experiment. The results in TABLE 18 show the D2S enzymes had nuclease activity.

TABLE 18

Indels by CasM19952

| Comp. Enzyme SEQ ID NO: | Indel percent | sgRNA SEQ ID NO: |
|---|---|---|
| PL5879, PL3651 23 | 0.104 | SEQ ID NO: 482 |
| PL5876, PL3651 23 | 0.111 | SEQ ID NO: 483 |
| PL5680, PL3651 23 | 0.111 | SEQ ID NO: 484 |
| PL5680, PL3651 23 | 0.111 | SEQ ID NO: 484 |
| PL5691, PL3651 23 | 0.120 | SEQ ID NO: 485 |
| PL5680, PL3651 23 | 0.122 | SEQ ID NO: 484 |
| PL5674, PL3651 23 | 0.125 | SEQ ID NO: 486 |
| PL5873, PL3651 23 | 0.133 | SEQ ID NO: 487 |
| PL5670, PL3651 23 | 0.138 | SEQ ID NO: 488 |
| PL5874, PL3651 23 | 0.140 | SEQ ID NO: 489 |
| PL5690, PL3651 23 | 0.142 | SEQ ID NO: 490 |
| PL5688, PL3651 23 | 0.142 | SEQ ID NO: 491 |
| PL5679, PL3651 23 | 0.149 | SEQ ID NO: 492 |
| PL5668, PL3651 23 | 0.153 | SEQ ID NO: 493 |
| PL5682, PL3651 23 | 0.161 | SEQ ID NO: 494 |
| PL5685, PL3651 23 | 0.162 | SEQ ID NO: 495 |
| PL5682, PL3651 23 | 0.177 | SEQ ID NO: 494 |

TABLE 18-continued

Indels by CasM19952

| Comp. Enzyme SEQ ID NO: | Indel percent | sgRNA SEQ ID NO: |
|---|---|---|
| PL5878, PL3651 23 | 0.182 | SEQ ID NO: 496 |
| PL5875, PL3651 23 | 0.186 | SEQ ID NO: 497 |
| PL5873, PL3651 23 | 0.190 | SEQ ID NO: 487 |
| PL5690, PL3651 23 | 0.200 | SEQ ID NO: 490 |
| PL5690, PL3651 23 | 0.225 | SEQ ID NO: 490 |
| PL5875, PL3651 23 | 0.231 | SEQ ID NO: 497 |
| PL5686, PL3651 23 | 0.241 | SEQ ID NO: 498 |
| PL5678, PL3651 23 | 0.245 | SEQ ID NO: 499 |
| PL5685, PL3651 23 | 0.270 | SEQ ID NO: 495 |
| PL5679, PL3651 23 | 0.276 | SEQ ID NO: 492 |
| PL5877, PL3651 23 | 0.298 | SEQ ID NO: 500 |
| PL5689, PL3651 23 | 0.315 | SEQ ID NO: 501 |
| PL5875, PL3651 23 | 0.326 | SEQ ID NO: 497 |
| PL5685, PL3651 23 | 0.343 | SEQ ID NO: 495 |
| PL5877, PL3651 23 | 0.355 | SEQ ID NO: 500 |
| PL5877, PL3651 23 | 0.367 | SEQ ID NO: 500 |
| PL5880, PL3651 23 | 0.409 | SEQ ID NO: 502 |
| PL5689, PL3651 23 | 0.421 | SEQ ID NO: 501 |
| PL5880, PL3651 23 | 0.440 | SEQ ID NO: 502 |
| PL5682, PL3651 23 | 0.448 | SEQ ID NO: 494 |
| PL5881, PL3651 23 | 0.450 | SEQ ID NO: 503 |
| PL5689, PL3651 23 | 0.453 | SEQ ID NO: 501 |
| PL5669, PL3651 23 | 0.467 | SEQ ID NO: 504 |
| PL5694, PL3651 23 | 0.520 | SEQ ID NO: 505 |
| PL5881, PL3651 23 | 0.601 | SEQ ID NO: 503 |
| PL5669, PL3651 23 | 0.617 | SEQ ID NO: 504 |
| PL5694, PL3651 23 | 0.639 | SEQ ID NO: 505 |
| PL5881, PL3651 23 | 0.656 | SEQ ID NO: 503 |
| PL5683, PL3651 23 | 0.658 | SEQ ID NO: 506 |
| PL5683, PL3651 23 | 0.665 | SEQ ID NO: 506 |
| PL5673, PL3651 23 | 0.669 | SEQ ID NO: 507 |
| PL5693, PL3651 23 | 0.681 | SEQ ID NO: 508 |
| PL5673, PL3651 23 | 0.681 | SEQ ID NO: 507 |
| PL5694, PL3651 23 | 0.684 | SEQ ID NO: 505 |
| PL5684, PL3651 23 | 0.704 | SEQ ID NO: 509 |
| PL5683, PL3651 23 | 0.710 | SEQ ID NO: 506 |
| PL5669, PL3651 23 | 0.713 | SEQ ID NO: 504 |
| PL5681, PL3651 23 | 0.723 | SEQ ID NO: 510 |
| PL5673, PL3651 23 | 0.736 | SEQ ID NO: 507 |
| PL5681, PL3651 23 | 0.738 | SEQ ID NO: 510 |
| PL5671, PL3651 23 | 0.748 | SEQ ID NO: 511 |
| PL5684, PL3651 23 | 0.761 | SEQ ID NO: 509 |
| PL5671, PL3651 23 | 0.800 | SEQ ID NO: 511 |
| PL5681, PL3651 23 | 0.850 | SEQ ID NO: 510 |
| PL5693, PL3651 23 | 0.924 | SEQ ID NO: 508 |
| PL5671, PL3651 23 | 0.945 | SEQ ID NO: 511 |
| PL5684, PL3651 23 | 1.041 | SEQ ID NO: 509 |
| PL5693, PL3651 23 | 1.053 | SEQ ID NO: 508 |
| PL5880, PL3651 23 | 1.513 | SEQ ID NO: 502 |
| PL5677, PL3651 23 | 2.340 | SEQ ID NO: 512 |
| PL5677, PL3651 23 | 2.377 | SEQ ID NO: 512 |
| PL5677, PL3651 23 | 2.613 | SEQ ID NO: 512 |
| PL5672, PL3651 23 | 2.630 | SEQ ID NO: 513 |
| PL5672, PL3651 23 | 2.861 | SEQ ID NO: 513 |
| PL5672, PL3651 23 | 3.629 | SEQ ID NO: 513 |
| PL5687, PL3651 23 | 4.047 | SEQ ID NO: 514 |
| PL5687, PL3651 23 | 4.083 | SEQ ID NO: 514 |
| PL5687, PL3651 23 | 4.211 | SEQ ID NO: 514 |
| PL5785, PL3651 23 | 4.762 | SEQ ID NO: 515 |
| PL5857, PL3651 23 | 8.796 | SEQ ID NO: 516 |
| PL5857, PL3651 23 | 8.869 | SEQ ID NO: 516 |
| PL5857, PL3651 23 | 9.317 | SEQ ID NO: 516 |
| PL5869, PL3651 23 | 10.779 | SEQ ID NO: 517 |
| PL5869, PL3651 23 | 11.648 | SEQ ID NO: 517 |
| PL5869, PL3651 23 | 11.715 | SEQ ID NO: 517 |
| PL5809, PL3651 23 | 12.082 | SEQ ID NO: 518 |
| PL5809, PL3651 23 | 12.323 | SEQ ID NO: 518 |
| PL5746, PL3651 23 | 12.385 | SEQ ID NO: 519 |
| PL5785 , PL3651 23 | 12.772 | SEQ ID NO: 515 |
| PL5746, PL3651 23 | 12.795 | SEQ ID NO: 519 |
| PL5821, PL3651 23 | 13.028 | SEQ ID NO: 520 |
| PL5675, PL3651 23 | 13.042 | SEQ ID NO: 521 |
| PL5695, PL3651 23 | 13.171 | SEQ ID NO: 522 |
| PL5809, PL3651 23 | 13.360 | SEQ ID NO: 518 |

TABLE 18-continued

Indels by CasM19952

| Comp. Enzyme SEQ ID NO: | Indel percent | sgRNA SEQ ID NO: |
|---|---|---|
| PL5695, PL3651 23 | 13.374 | SEQ ID NO: 522 |
| PL5785, PL3651 23 | 13.415 | SEQ ID NO: 515 |
| PL5675, PL3651 23 | 13.541 | SEQ ID NO: 521 |
| PL5695, PL3651 23 | 13.558 | SEQ ID NO: 522 |
| PL5696, PL3651 23 | 13.690 | SEQ ID NO: 523 |
| PL5675, PL3651 23 | 13.691 | SEQ ID NO: 521 |
| PL5821, PL3651 23 | 13.959 | SEQ ID NO: 520 |
| PL5821, PL3651 23 | 14.008 | SEQ ID NO: 520 |
| PL5696, PL3651 23 | 14.387 | SEQ ID NO: 523 |
| PL5696, PL3651 23 | 14.427 | SEQ ID NO: 523 |
| PL5746, PL3651 23 | 14.455 | SEQ ID NO: 519 |
| PL5813, PL3651 23 | 14.671 | SEQ ID NO: 524 |
| PL5788, PL3651 23 | 14.932 | SEQ ID NO: 525 |
| PL5788, PL3651 23 | 14.947 | SEQ ID NO: 525 |
| PL5788, PL3651 23 | 15.031 | SEQ ID NO: 525 |
| PL5743, PL3651 23 | 15.306 | SEQ ID NO: 526 |
| PL5817, PL3651 23 | 15.431 | SEQ ID NO: 527 |
| PL5787, PL3651 23 | 15.780 | SEQ ID NO: 528 |
| PL5825, PL3651 23 | 15.781 | SEQ ID NO: 529 |
| PL5745, PL3651 23 | 16.012 | SEQ ID NO: 530 |
| PL5825, PL3651 23 | 16.080 | SEQ ID NO: 529 |
| PL5787, PL3651 23 | 16.133 | SEQ ID NO: 528 |
| PL5745, PL3651 23 | 16.234 | SEQ ID NO: 530 |
| PL5813, PL3651 23 | 16.242 | SEQ ID NO: 524 |
| PL5787, PL3651 23 | 16.243 | SEQ ID NO: 528 |
| PL5813, PL3651 23 | 16.299 | SEQ ID NO: 524 |
| PL5745, PL3651 23 | 16.379 | SEQ ID NO: 530 |
| PL5817, PL3651 23 | 16.437 | SEQ ID NO: 527 |
| PL5825, PL3651 23 | 17.232 | SEQ ID NO: 529 |
| PL5837, PL3651 23 | 17.270 | SEQ ID NO: 531 |
| PL5748, PL3651 23 | 17.325 | SEQ ID NO: 532 |
| PL5697, PL3651 23 | 17.376 | SEQ ID NO: 533 |
| PL5748, PL3651 23 | 17.397 | SEQ ID NO: 532 |
| PL5841, PL3651 23 | 17.403 | SEQ ID NO: 534 |
| PL5737, PL3651 23 | 17.410 | SEQ ID NO: 180 |
| PL5740, PL3651 23 | 17.422 | SEQ ID NO: 535 |
| PL5739, PL3651 23 | 17.476 | SEQ ID NO: 536 |
| PL5739, PL3651 23 | 17.507 | SEQ ID NO: 536 |
| PL5739, PL3651 23 | 17.567 | SEQ ID NO: 536 |
| PL5744, PL3651 23 | 17.667 | SEQ ID NO: 537 |
| PL5817, PL3651 23 | 17.743 | SEQ ID NO: 527 |
| PL5740, PL3651 23 | 17.800 | SEQ ID NO: 535 |
| PL5742, PL3651 23 | 17.891 | SEQ ID NO: 538 |
| PL5737, PL3651 23 | 17.985 | SEQ ID NO: 180 |
| PL5697, PL3651 23 | 18.004 | SEQ ID NO: 533 |
| PL5740, PL3651 23 | 18.009 | SEQ ID NO: 535 |
| PL5845, PL3651 23 | 18.138 | SEQ ID NO: 539 |
| PL5744, PL3651 23 | 18.142 | SEQ ID NO: 537 |
| PL5743, PL3651 23 | 18.158 | SEQ ID NO: 526 |
| PL5789, PL3651 23 | 18.162 | SEQ ID NO: 540 |
| PL5829, PL3651 23 | 18.319 | SEQ ID NO: 541 |
| PL5743, PL3651 23 | 18.573 | SEQ ID NO: 526 |
| PL5829, PL3651 23 | 18.654 | SEQ ID NO: 541 |
| PL5738, PL3651 23 | 18.716 | SEQ ID NO: 542 |
| PL5845, PL3651 23 | 18.796 | SEQ ID NO: 539 |
| PL5837, PL3651 23 | 18.832 | SEQ ID NO: 531 |
| PL5829, PL3651 23 | 18.903 | SEQ ID NO: 541 |
| PL5697, PL3651 23 | 18.935 | SEQ ID NO: 533 |
| PL5744, PL3651 23 | 19.177 | SEQ ID NO: 537 |
| PL5790, PL3651 23 | 19.269 | SEQ ID NO: 543 |
| PL5837 , PL3651 23 | 19.359 | SEQ ID NO: 531 |
| PL5738, PL3651 23 | 19.376 | SEQ ID NO: 542 |
| PL5738, PL3651 23 | 19.393 | SEQ ID NO: 542 |
| PL5737, PL3651 23 | 19.431 | SEQ ID NO: 180 |
| PL5789, PL3651 23 | 19.438 | SEQ ID NO: 540 |
| PL5841, PL3651 23 | 19.445 | SEQ ID NO: 534 |
| PL5845, PL3651 23 | 19.518 | SEQ ID NO: 539 |
| PL5742, PL3651 23 | 19.719 | SEQ ID NO: 538 |
| PL5841, PL3651 23 | 19.736 | SEQ ID NO: 534 |
| PL5833, PL3651 23 | 19.841 | SEQ ID NO: 544 |
| PL5790, PL3651 23 | 19.903 | SEQ ID NO: 543 |
| PL5747, PL3651 23 | 20.101 | SEQ ID NO: 545 |
| PL5747, PL3651 23 | 20.142 | SEQ ID NO: 545 |
| PL5849, PL3651 23 | 20.220 | SEQ ID NO: 546 |

TABLE 18-continued

Indels by CasM19952

| Comp. Enzyme SEQ ID NO: | Indel percent | sgRNA SEQ ID NO: |
|---|---|---|
| PL5742, PL3651 23 | 20.326 | SEQ ID NO: 538 |
| PL5790, PL3651 23 | 20.725 | SEQ ID NO: 543 |
| PL5789, PL3651 23 | 21.113 | SEQ ID NO: 540 |
| PL5833, PL3651 23 | 21.632 | SEQ ID NO: 544 |
| PL5748, PL3651 23 | 21.703 | SEQ ID NO: 532 |
| PL5833, PL3651 23 | 21.746 | SEQ ID NO: 544 |
| PL5786, PL3651 23 | 21.806 | SEQ ID NO: 547 |
| PL5849, PL3651 23 | 21.858 | SEQ ID NO: 546 |
| PL5747, PL3651 23 | 21.953 | SEQ ID NO: 545 |
| PL5849, PL3651 23 | 22.178 | SEQ ID NO: 546 |
| PL5786, PL3651 23 | 22.673 | SEQ ID NO: 547 |
| PL5786, PL3651 23 | 22.987 | SEQ ID NO: 547 |
| PL5741, PL3651 23 | 24.052 | SEQ ID NO: 548 |
| PL5741, PL3651 23 | 24.284 | SEQ ID NO: 548 |
| PL5741, PL3651 23 | 24.376 | SEQ ID NO: 548 |
| PL5853, PL3651 23 | 26.455 | SEQ ID NO: 549 |
| PL5853, PL3651 23 | 27.069 | SEQ ID NO: 549 |
| PL5853, PL3651 23 | 28.127 | SEQ ID NO: 549 |

Example 11: D2S Enzyme Edit Genomic DNA in Mammalian Cells

D2S effectors were tested for their ability to produce indels in HEK293T cells. Briefly, 300 ng of plasmids expressing effector and transcribing targeting gRNA were delivered by lipofection to HEK293T cells in 96 well plates. TransIT-293 reagent was diluted with warmed up OPTIMEM and mixed with the plasmid DNA at the ratio of 2:1 lipid:DNA. Lipid:DNA mixture were incubated for 10 minutes at room temperature before adding 20 μL of the lipid:DNA optimem mixture to each well. Cells were incubated for 3 days before being lysed and subjected to PCR amplification. TABLE 19 shows the constructs (e.g., composition) test and their indel percent in HEK293T cells. Additionally, TABLE 19 also shows the effector protein Seq ID NO (under Enzyme Seq ID NO), and the crRNA or sgRNA sequence if applicable.

Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" and SpyCas9 were included as negative and positive controls, respectively. TABLE 19 shows the results of this experiment. The results in TABLE 19 show the D2S enzymes had nuclease activity.

TABLE 19

Indels by D2S effectors

| Comp. Enzyme SEQ ID NO: | Indel percent | cr/sgRNA SEQ ID NO: | cr/sgRNA | tracrRNA if applicable |
|---|---|---|---|---|
| PL4891 211 | 0.498 | SEQ ID NO: 550 | crRNA in plasmid | CGAUUCCUCCCUACAGUAG UUAGGUAUAGCCGAAAGGU |
| PL4895 211 | 0.149 | SEQ ID NO: 551 | crRNA in plasmid | AGAGACUAAAUCUGUAGUU GGAGUGGGCCGCUUGCAUC |
| PL4904 211 | 1.028 | SEQ ID NO: 552 | crRNA in plasmid | GGCCUAAAGUUGAGAAGUG UCAGACUCUGAUAACCCUC |
| PL4907 211 | 0.500 | SEQ ID NO: 553 | crRNA in plasmid | AACGACGAUAUUCUUUAUU UCGGUUCAAAGUUCUGCAC |
| PL4908 211 | 0.198 | SEQ ID NO: 554 | crRNA in plasmid | AAAACAGGUGAGUCCUUAU AAACCGGUGUGCAGAACG |
| PL4909 211 | 0.965 | SEQ ID NO: 555 | crRNA in plasmid | (SEQ ID NO: 938) |
| PL4915 230 | 0.639 | SEQ ID NO: 550 | crRNA in plasmid | CGAUUCCUCCCUACAGUAG AGAGACUAAAUCUGUAGUU |
| PL4919 230 | 0.159 | SEQ ID NO: 551 | crRNA in plasmid | GGAGUGGGCCGCUUGCAUC UUAGGUAUAGCCGAAAGGU |
| PL4932 230 | 0.185 | SEQ ID NO: 554 | crRNA in plasmid | GGCCUAAAGUUGAGAAGUG UCAGACUCUGAUAACCCUC AACGACGAUAUUCUUUAUU UCGGUUCAAAGUUCUGCAC AAAACAGGUGAGUCCUUAU AAACCGGUGUGCAGAACG (SEQ ID NO: 939) |

TABLE 19-continued

Indels by D2S effectors

| Comp. Enzyme SEQ ID NO: | Indel percent | cr/sgRNA SEQ ID NO: | cr/sgRNA | tracrRNA if applicable |
|---|---|---|---|---|
| PL4942 226 | 0.260 | SEQ ID NO: 556 | crRNA in plasmid | CGAUUCCUCCCUACAGUAG UUAGGUAUAGCCGAAAGGU |
| PL4952 226 | 0.167 | SEQ ID NO: 557 | crRNA in plasmid | AGAGACUAAAUCUGUAGUU GGAGUGGGCCGCUUGCAUC GGCCUAAAGUUGAGAAGUG UCAGACUCUGAUAACCCUC AACGACGAUAUUCUUUAUU UCGGUUCAAAGUUCUGCAC AAAACAGGUGAGUCCUUAU AAACCGGUGUGCAGAACG (SEQ ID NO: 940) |
| PL4293 22 | 0.327 | SEQ ID NO: 558 | sgRNA in plasmid | N/A |
| PL4295 22 | 0.426 | SEQ ID NO: 559 | sgRNA in plasmid | N/A |
| PL4296 22 | 0.133 | SEQ ID NO: 181 | sgRNA in plasmid | N/A |
| PL4298 22 | 0.117 | SEQ ID NO: 182 | sgRNA in plasmid | N/A |
| PL4304 22 | 3.592 | SEQ ID NO: 184 | sgRNA in plasmid | N/A |
| PL4305 22 | 0.467 | SEQ ID NO: 560 | sgRNA in plasmid | N/A |
| PL4308 22 | 0.105 | SEQ ID NO: 561 | sgRNA in plasmid | N/A |
| PL4309 22 | 0.916 | SEQ ID NO: 185 | sgRNA in plasmid | N/A |
| PL4341 24 | 0.172 | SEQ ID NO: 562 | sgRNA in plasmid | N/A |
| PL4342 24 | 0.197 | SEQ ID NO: 563 | sgRNA in plasmid | N/A |
| PL4343 24 | 1.157 | SEQ ID NO: 564 | sgRNA in plasmid | N/A |
| PL4345 24 | 1.441 | SEQ ID NO: 565 | sgRNA in plasmid | N/A |
| PL4346 24 | 0.101 | SEQ ID NO: 566 | sgRNA in plasmid | N/A |
| PL4352 24 | 0.102 | SEQ ID NO: 567 | sgRNA in plasmid | N/A |
| PL4353 24 | 0.260 | SEQ ID NO: 568 | sgRNA in plasmid | N/A |
| PL4356 24 | 0.166 | SEQ ID NO: 569 | sgRNA in plasmid | N/A |
| PL4358 25 | 0.182 | SEQ ID NO: 570 | sgRNA in plasmid | N/A |
| PL4360 25 | 0.662 | SEQ ID NO: 481 | sgRNA in plasmid | N/A |
| PL4375 25 | 9.193 | SEQ ID NO: 571 | sgRNA in plasmid | N/A |
| PL4378 25 | 0.550 | SEQ ID NO: 572 | sgRNA in plasmid | N/A |
| PL4381 25 | 0.970 | SEQ ID NO: 573 | sgRNA in plasmid | N/A |

TABLE 19-continued

Indels by D2S effectors

| Comp. Enzyme SEQ ID NO: | Indel percent | cr/sgRNA SEQ ID NO: | cr/sgRNA | tracrRNA if applicable |
|---|---|---|---|---|
| PL4389 26 | 0.160 | SEQ ID NO: 558 | sgRNA in plasmid | N/A |
| PL4391 26 | 0.373 | SEQ ID NO: 559 | sgRNA in plasmid | N/A |
| PL4404 26 | 0.193 | SEQ ID NO: 561 | sgRNA in plasmid | N/A |
| PL4406 28 | 0.238 | SEQ ID NO: 574 | sgRNA in plasmid | N/A |
| PL4408 28 | 0.783 | SEQ ID NO: 575 | sgRNA in plasmid | N/A |
| PL4417 28 | 0.131 | SEQ ID NO: 576 | sgRNA in plasmid | N/A |
| PL4426 28 | 0.639 | SEQ ID NO: 577 | sgRNA in plasmid | N/A |
| PL4427 28 | 0.247 | SEQ ID NO: 578 | sgRNA in plasmid | N/A |
| PL4434 29 | 0.889 | SEQ ID NO: 579 | sgRNA in plasmid | N/A |
| PL4453 29 | 0.106 | SEQ ID NO: 580 | sgRNA in plasmid | N/A |
| PL4454 31 | 0.271 | SEQ ID NO: 570 | sgRNA in plasmid | N/A |
| PL4456 31 | 0.822 | SEQ ID NO: 481 | sgRNA in plasmid | N/A |
| PL4474 31 | 0.560 | SEQ ID NO: 572 | sgRNA in plasmid | N/A |
| PL4477 31 | 0.756 | SEQ ID NO: 573 | sgRNA in plasmid | N/A |
| PL4486 32 | 0.156 | SEQ ID NO: 581 | sgRNA in plasmid | N/A |
| PL4487 32 | 0.299 | SEQ ID NO: 582 | sgRNA in plasmid | N/A |
| PL4488 32 | 0.260 | SEQ ID NO: 583 | sgRNA in plasmid | N/A |
| PL4497 32 | 0.316 | SEQ ID NO: 584 | sgRNA in plasmid | N/A |
| PL4500 32 | 0.409 | SEQ ID NO: 585 | sgRNA in plasmid | N/A |
| PL4501 32 | 0.364 | SEQ ID NO: 586 | sgRNA in plasmid | N/A |
| PL4510 30 | 0.116 | SEQ ID NO: 581 | sgRNA in plasmid | N/A |
| PL4513 30 | 0.825 | SEQ ID NO: 587 | sgRNA in plasmid | N/A |
| PL4520 30 | 0.338 | SEQ ID NO: 588 | sgRNA in plasmid | N/A |
| PL4524 30 | 0.241 | SEQ ID NO: 585 | sgRNA in plasmid | N/A |

TABLE 19-continued

Indels by D2S effectors

| Comp. Enzyme SEQ ID NO: | Indel percent | cr/sgRNA SEQ ID NO: | cr/sgRNA | tracrRNA if applicable |
|---|---|---|---|---|
| PL4670 34 | 0.191 | SEQ ID NO: 574 | sgRNA in plasmid | N/A |
| PL4699 15 | 0.239 | SEQ ID NO: 589 | crRNA in plasmid | GAAGGCCGACCUGUACGGC CUUAAGGUUGAGAAGGCAC |
| PL4700 15 | 0.219 | SEQ ID NO: 590 | crRNA in plasmid | AUGUAAGUGGAAAAAUGCU CCAAGCACACACGUUUUUU |
| PL4701 15 | 0.230 | SEQ ID NO: 591 | crRNA in plasmid | UUCCCGUUGUGUUCGCUCA U (SEQ ID NO: 107) |
| PL4751 44 | 0.122 | SEQ ID NO: 592 | crRNA in plasmid | AUAUUAAGGGCGGCUCAGC GUCCUUAAGUCGAGAAAGU AUACAUAAAUUUCUUAUAU AGAAUAGUAGAUACUCUCG GCAAGGUAUAAACCCUACA AAUUUAAUCCUUGUAGGCA ACUUAUAUUUGUAUUUAUU U (SEQ ID NO: 145) |
| PL4771 45 | 0.623 | SEQ ID NO: 593 | crRNA in plasmid | AAACAAGGGCGGCUCAACG UCCUAGAAUCGAGAAAGUA |
| PL4788 45 | 0.217 | SEQ ID NO: 594 | crRNA in plasmid | UGCGUAAGACUUAUUUAUU GAGCGGUAGAUACUCUCGG UAAGGUAUAAAUUC (SEQ ID NO: 148) |
| PL4862 34 | 0.186 | SEQ ID NO: 595 | crRNA in plasmid | AUGAAUAGGAUUUAUCCUA UGGGGCAGUUGGUUGCCCU |
| PL4864 34 | 0.637 | SEQ ID NO: 596 | crRNA in plasmid | UAGCCUGAGGCAUUUAAUG CACUCGGGAAGUACCUUUU |
| PL4882 34 | 0.423 | SEQ ID NO: 597 | crRNA in plasmid | CUCA (SEQ ID NO: 121) |

Example 12: PAM Screening for D2S Effector Proteins

D2S effector proteins and guide RNA combinations were screened by in vitro enrichment (IVE) for PAM recognition. Effector proteins and guide RNAs were expressed and purified from HEK293T cells. Briefly, effector proteins were complexed with corresponding guide RNAs for 15 minutes at 37° C. The complexes were added to an IVE reaction mix. PAM screening reactions used 10 µl of RNP in 100 µl reactions with 1,000 ng of a 5′ PAM library in 1× Cutsmart buffer and were carried out for 15 minutes at 25° C., 45 minutes at 37° C. and 15 minutes at 45° C. Reactions were terminated with 1 µl of proteinase K and 5 µl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 20) generally had lower signal due to more noise than the 1% (PAM 1% in TABLE 20). In some cases, the 1% enrichment met the cutoff criteria, but the 5% enrichment did not. In such cases, a PAM is included for the 1% enrichment, but not the 5% enrichment. Complexes (e.g., the composition) and corresponding identified PAMs are provided in TABLE 20. Additionally, TABLE 20 also shows the effector protein Seq ID NO (under Enzyme Seq ID NO), and the cr/sgRNA designation number, tracr RNA designation number, and their corresponding sequences if applicable. FIGS. 7A-7E illustrate PAM preferences for the different D2S effector proteins used in this example. As shown in TABLE 20, examination the IVE assay revealed the presence of enriched 5′ PAM consensus sequences for the various D2S effector proteins.

TABLE 20

Compositions for D2S effector protein PAM screening

| Comp. Enzyme SEQ ID NO: | PAM 1% | PAM 5% | cr/sgRNA # cr/sgRNA SEQ ID NO: | cr/ sgRNA | tracrRNA # tracrRNA SEQ ID NO: |
|---|---|---|---|---|---|
| PL5632, R5724, R5780 227 | NNNNTYN (SEQ ID NO: 335) | NNNNTYN (SEQ ID NO: 335) | R5724 (SEQ ID NO: 598) | crRNA | R5780 (SEQ ID NO: 599) |
| PL5636, R5693, R5827 231 | NNNNCCR (SEQ ID NO: 313) | NNNNCCN (SEQ ID NO: 312) | R5693 (SEQ ID NO: 600) | crRNA | R5827 (SEQ ID NO: 601) |
| PL5637, R5865 239 | NNNNNCC (SEQ ID NO: 315) | NNNNNCC (SEQ ID NO: 315) | R5865 (SEQ ID NO: 602) | sgRNA | |

TABLE 20-continued

Compositions for D2S effector protein PAM screening

| Comp. Enzyme SEQ ID NO: | PAM 1% | PAM 5% | cr/sgRNA # cr/sgRNA SEQ ID NO: | cr/ sgRNA | tracrRNA # tracrRNA SEQ ID NO: |
|---|---|---|---|---|---|
| PL5637, R5866 239 | NNNNNCC (SEQ ID NO: 315) | NNNNNCC (SEQ ID NO: 315) | R5866 (SEQ ID NO: 603) | sgRNA | |
| PL5638, R4876, R4942 16 | NNNNNCC (SEQ ID NO: 315) | NNNNNCC (SEQ ID NO: 315) | R4876 (SEQ ID NO: 60) | crRNA | R4942 (SEQ ID NO: 107) |
| PL5638, R4849, R5952 16 | NNNNNCC (SEQ ID NO: 315) | NNNNNCC (SEQ ID NO: 315) | R4849 (SEQ ID NO: 61) | crRNA | R5952 (SEQ ID NO: 604) |
| PL5638, R5917 16 | NNNNNCC (SEQ ID NO: 315) | NNNNNCC (SEQ ID NO: 315) | R5917 (SEQ ID NO: 605) | sgRNA | |
| PL5638, R5919 16 | NNNNNCC (SEQ ID NO: 315) | NNNNNCC (SEQ ID NO: 315) | R5919 (SEQ ID NO: 606) | sgRNA | |
| PL5642, R4852, R4908 19 | NNNNNCC (SEQ ID NO: 315) | NNNNNCC (SEQ ID NO: 315) | R4852 (SEQ ID NO: 64) | crRNA | R4908 (SEQ ID NO: 607) |
| PL5642, R4852, R5955 19 | NNNNNCC (SEQ ID NO: 315) | NNNNNCC (SEQ ID NO: 315) | R4852 (SEQ ID NO: 64) | crRNA | R5955 (SEQ ID NO: 608) |
| PL5642, R5917 19 | NNNNNCC (SEQ ID NO: 315) | NNNNNCC (SEQ ID NO: 315) | R5917 (SEQ ID NO: 605) | sgRNA | |
| PL5643, R4853, R5956 20 | NNNNNCC (SEQ ID NO: 315) | NNNNNCC (SEQ ID NO: 315) | R4853 (SEQ ID NO: 62) | crRNA | R5956 (SEQ ID NO: 609) |
| PL5649, R5853 207 | NNANRTT (SEQ ID NO: 304) | NNNNRTT (SEQ ID NO: 324) | R5853 (SEQ ID NO: 610) | sgRNA | |
| PL5640, R5917 14 | NNNNNCC (SEQ ID NO: 315) | NNNNNCC (SEQ ID NO: 315) | R5917 (SEQ ID NO: 605) | sgRNA | |
| PL5640, R5919 14 | NNNNNCC (SEQ ID NO: 315) | NNNNNCC (SEQ ID NO: 315) | R5919 (SEQ ID NO: 606) | sgRNA | |
| PL5640, R4876, R4942 14 | NNNNNCC (SEQ ID NO: 315) | NNNNNCC (SEQ ID NO: 315) | R4876 (SEQ ID NO: 60) | crRNA | R4942 (SEQ ID NO: 611) |

Example 13: PAM Screening for D2S Effector Proteins

D2S effector proteins and guide RNA combinations were screened by in vitro enrichment (IVE) for PAM recognition. Effector proteins and guide RNAs were expressed and purified from E. coli. Briefly, effector proteins were complexed with corresponding guide RNAs for 15 minutes at 37° C. The complexes were added to an IVE reaction mix. PAM screening reactions used 10 µl of RNP in 100 µl reactions with 1,000 ng of a 5' PAM library in 1× Cutsmart buffer and were carried out for 15 minutes at 25° C., 45 minutes at 37° C. and 15 minutes at 45° C. Reactions were terminated with 1 µl of proteinase K and 5 µl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 21) generally had lower signal due to more noise than the 1% (PAM 1% in TABLE 21). In some cases, the 1% enrichment met the cutoff criteria, but the 5% enrichment did not. In such cases, a PAM is included for the 1% enrichment, but not the 5% enrichment. Complexes (e.g., the composition) and corresponding identified PAMs are provided in TABLE 21. Additionally, TABLE 21 also shows the effector protein Seq ID NO (under Enzyme Seq ID NO), the cr/sgRNA designation number, its corresponding sequence if applicable. FIGS. 7A-7E illustrate PAM preferences for the different D2S effector proteins used in this example. As shown in TABLE 21, examination the WE assay revealed the presence of enriched 5' PAM consensus sequences for the various D2S effector proteins.

TABLE 21

Compositions for D2S effector protein PAM screening

| Comp. Enzyme SEQ ID NO: | PAM 1% | PAM 5% | cr/sgRNA # cr/sgRNA_SEQ ID NO: | cr/ sgRNA |
|---|---|---|---|---|
| PL4970, R7618 232 | NNTTTYN (SEQ ID NO: 365) | NNNNTYN (SEQ ID NO: 335) | R7618 (SEQ ID NO: 612) | sgRNA |

TABLE 21-continued

Compositions for D2S effector protein PAM screening

| Comp. Enzyme SEQ ID NO: | PAM 1% | PAM 5% | cr/sgRNA # cr/sgRNA_SEQ ID NO: | cr/sgRNA |
|---|---|---|---|---|
| PL4991, 233 | NNNWNTG (SEQ ID NO: 360) | NNNNNTG (SEQ ID NO: 318) | R7605 (SEQ ID NO: 613) | sgRNA |
| PL4992, 240 | NNNRTRG (SEQ ID NO: 343) | NNNNNNG (SEQ ID NO: 301) | R7608 (SEQ ID NO: 614) | sgRNA |
| PL5632, 227 | NNNNTYN (SEQ ID NO: 335) | NNNNTYN (SEQ ID NO: 335) | R7620 (SEQ ID NO: 615) | sgRNA |

Example 14: D2S Enzyme Edit Genomic DNA in Mammalian Cells

An enzyme was tested for its ability to produce indels in HEK293T cells. Briefly, a plasmid encoding the enzyme and guide RNA was delivered by lipofection to HEK293T cells. Cells were incubated for approximately 48 hours before being lysed. Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. "No plasmid" and SpyCas9 were included as negative and positive controls, respectively. TABLE 22 describes the sequence of the single guide RNA tested and percent of reads with indels. Additionally, TABLE 22 shows the composition tested, the PAM 1% enrichment sequence, the effector protein Seq ID NO (under Enzyme Seq ID NO), and the sgRNA sequence if applicable. The results in TABLE 22 show the D2S enzyme had nuclease activity.

TABLE 22

Indels by an D2S effector

| Comp. | PAM 1% | Indel percent | Enzyme SEQ ID NO: | sgRNA SEQ ID NO: |
|---|---|---|---|---|
| PL6015 | TNTG (SEQ ID NO: 368) | 0.385 | 228 | SEQ ID NO: 616 |

Example 15: PAM Screening for D2S Effector Proteins

D2S effector proteins and guide RNA combinations were screened by in vitro enrichment (IVE) for PAM recognition. Effector proteins and guide RNAs were expressed and purified from E. coli cells. Briefly, effector proteins were complexed with corresponding guide RNAs for 15 minutes at 37° C. The complexes were added to an IVE reaction mix. PAM screening reactions used 10 μl of RNP in 100 μl reactions with 1,000 ng of a 5′ PAM library in 1× Cutsmart buffer and were carried out for 15 minutes at 25° C., 45 minutes at 37° C. and 15 minutes at 45° C. Reactions were terminated with 1 μl of proteinase K and 5 μl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 23) generally had lower signal due to more noise than the 1% (PAM 1% in TABLE 23). In some cases the 1% enrichment met the cutoff criteria, but the 5% enrichment did not. In such cases, a PAM is included for the 1% enrichment, but not the 5% enrichment. Complexes (e.g., the composition) and corresponding identified PAMs are provided in TABLE 23. Additionally, TABLE 23 also shows the effector protein Seq ID NO (under Enzyme Seq ID NO), and the cr/sgRNA designation number, tracr RNA designation number, and their corresponding sequences if applicable. FIGS. 7A-7E illustrate PAM preferences for the different D2S effector proteins used in this example. As shown in TABLE 23, examination the IVE assay revealed the presence of enriched 5′ PAM consensus sequences for the various D2S effector proteins.

TABLE 23

Compositions for D2S effector protein PAM screening

| Comp. | Enzyme SEQ ID NO: | PAM1% | PAM5% | cr/sgRNA # cr/sgRNA SEQ ID NO: | cr/sgRNA | tracrRNA # tracrRNA SEQ ID NO: |
|---|---|---|---|---|---|---|
| PL5370, R6401, R6631 | 215 | NNNRTRG (SEQ ID NO: 343) | NNNRTRG (SEQ ID NO: 343) | R6401 (SEQ ID NO: 617) | crRNA | R6631 (SEQ ID NO: 618) |
| PL5370, R6401, R6630 | 215 | NNNRTRG (SEQ ID NO: 343) | NNNRTRG (SEQ ID NO: 343) | R6401 (SEQ ID NO: 617) | crRNA | R6630 (SEQ ID NO: 619) |
| PL5370, R6708 | 215 | NNNRTRG (SEQ ID NO: 343) | NNNRTRG (SEQ ID NO: 343) | R6708 (SEQ ID NO: 620) | sgRNA | |
| PL5370, R6707 | 215 | NNNRTRG (SEQ ID NO: 343) | NNNRTRG (SEQ ID NO: 343) | R6707 (SEQ ID NO: 621) | sgRNA | |

Example 16: PAM Screening for D2S Effector Proteins

D2S effector proteins and guide RNA combinations were screened by in vitro enrichment (IVE) for PAM recognition. Effector proteins and guide RNAs were expressed and purified from E. coli. Briefly, effector proteins were complexed with corresponding guide RNAs for 15 minutes at 37° C. The complexes were added to an IVE reaction mix. PAM screening reactions used 10 μl of RNP in 100 μl reactions with 1,000 ng of a 5' PAM library in 1× Cutsmart buffer and were carried out for 15 minutes at 25° C., 45 minutes at 37° C. and 15 minutes at 45° C. Reactions were terminated with 1 μl of proteinase K and 5 μl of 500 mM EDTA for 30 minutes at 37° C. Cis cleavage by each complex was confirmed by gel electrophoresis. Next generation sequencing was performed on cut sequences to confirm enriched PAMs. The PAM enrichment for the top 5% enrichment (PAM 5% in TABLE 24) generally had lower signal due to more noise than the 1% (PAM 1% in TABLE 24). Complexes (e.g., the composition) and corresponding identified PAMs are provided in TABLE 24. Additionally, TABLE 24 also shows the effector protein Seq ID NO (under Enzyme Seq ID NO), and the cr/sgRNA designation number, tracr RNA designation number, and their corresponding sequences if applicable. As shown in TABLE 24, the IVE assay revealed the presence of enriched 5' PAM consensus sequences for the effector protein SEQ ID NO: 23.

TABLE 24

Compositions for D2S effector protein PAM screening

| Comp. Enzyme Seq ID NO: | PAM 1% | PAM_5% | cr/sgRNA # cr/sgRNA Seq ID NO: | cr/sgRNA | tracrRNA # tracrRNA Seq ID NO: |
|---|---|---|---|---|---|
| PL3296, R4856, R4893 23 | NNNNKCG (SEQ ID NO: 326) | NNNNKYG (SEQ ID NO: 327) | R4856 (SEQ ID NO: 68) | crRNA | R4893 (SEQ ID NO: 120) |
| PL3296, R4856, R4893 23 | NNNNKCG (SEQ ID NO: 326) | NNNNKYG (SEQ ID NO: 327) | R4856 (SEQ ID NO: 68) | crRNA | R4893 (SEQ ID NO: 120) |
| PL3296, R4856, R4893 23 | NNNNTCG (SEQ ID NO: 325) | NNNNTYG (SEQ ID NO: 328) | R4856 (SEQ ID NO: 68) | crRNA | R4893 (SEQ ID NO: 120) |
| PL3296, R4886 23 | NNNNTYG (SEQ ID NO: 328) | NNNNTYG (SEQ ID NO: 328) | R4886 (SEQ ID NO: 149) | sgRNA | |
| PL3296, 4886 23 | NNNNTCG (SEQ ID NO: 325) | NNNNTYG (SEQ ID NO: 328) | R4886 (SEQ ID NO: 149) | sgRNA | |
| PL3296, R4886 23 | NNNNTYG (SEQ ID NO: 328) | NNNNTYG (SEQ ID NO: 328) | R4886 (SEQ ID NO: 149) | sgRNA | |

Example 17: Guide RNA Optimization of Repeat Sequences

Guide RNAs were optimized for specific repeat sequences and designed to increase indel frequency. Repeat sequences were mutated and/or truncated for optimization. Guides with the optimized repeat sequence were tested in the indel experiments described herein for their ability to produce indels. Table 25 shows the different parts of the optimized guide RNA sequences (i.e., the tracrRNA sequence, the linker sequence, the repeat sequence, the spacer sequence, and the full sgRNA sequence).

TABLE 25

Optimized Guide Sequences

| Enzyme Seq ID NO: | TracrRNA Sequence | Linker sequence | Repeat Sequence | Spacer sequence | Full sgRNA sequence |
|---|---|---|---|---|---|
| 23 | UGGGGCAGUUGGUUGCCCUU AGCCUGAGGCAUUUAUUGCA CUCGGGAAGUACCAUUUCUC A (SEQ ID NO: 622) | GAAA (SEQ ID NO: 623) | UGGUAUA UCCAAC (SEQ ID NO: 624) | GUGCCUUA GUUUCUUC AUCU (SEQ ID NO: 625) | UGGGGCAGUUGGUUGCCCUUAGCCUGAGGCAUUU AUUGCACUCGGGAAGUACCAUUUCUCAGAAAUGG UAUAUCCAACGUGCCUUAGUUUCUUCAUCU (SEQ ID NO: 626) |
| 23 | UGGGGCAGUUGGUUGCCCUU AGCCUGAGGCAUUUAUUGCA CUCGGGAAGUACCAU (SEQ ID NO: 627) | | UACAUCC AAC (SEQ ID NO: 628) | UCUAGGCG CCCGCUAA GUUC (SEQ ID NO: 629) | UGGGGCAGUUGGUUGCCCUUAGCCUGAGGCAUUU AUUGCACUCGGGAAGUACCAUUACAUCCAACUCU AGGCGCCCGCUAAGUUC (SEQ ID NO: 517) |
| 23 | UGGGGCAGUUGGUUGCCCUU AGCCUGAGGCAUUUAUUGCA CUCGGGAAGUACCAUUUCUC A (SEQ ID NO: 622) | GAAA (SEQ ID NO: 623) | UGGUACA UCCAAC (SEQ ID NO: 630) | CGUGCUGU UUCCUCCC CACA (SEQ ID NO: 631) | UGGGGCAGUUGGUUGCCCUUAGCCUGAGGCAUUU AUUGCACUCGGGAAGUACCAUUUCUCAGAAAUGG UACAUCCAACCGUGCUGUUUCCUCCCCACA (SEQ ID NO: 632) |
| 23 | AUGGGGCAGUUGGUUGCCCU UAGCCUGAGGCAUUUAAUGC ACUCGGGA (SEQ ID NO: 633) | GAAA (SEQ ID NO: 623) | AAC (SEQ ID NO: 634) | CGUGCUGU UUCCUCCC CACG (SEQ ID NO: 635) | AUGGGGCAGUUGGUUGCCCUUAGCCUGAGGCAUU UAAUGCACUCGGGAGAAAAACCGUGCUGUUUCCU CCCCACG (SEQ ID NO: 636) |
| 23 | AUGGGGCAGUUGGUUGCCCU UAGCCUGAGGCAUUUAAUGC ACUCGGGAAGUACC (SEQ ID NO: 637) | GAAA (SEQ ID NO: 623) | AUCCAAC (SEQ ID NO: 638) | CGUGCUGU UUCCUCCC CACG (SEQ ID NO: 635) | AUGGGGCAGUUGGUUGCCCUUAGCCUGAGGCAUU UAAUGCACUCGGGAAGUACCGAAAAUCCAACCGU GCUGUUUCCUCCCCACG (SEQ ID NO: 639) |
| 23 | AUGGGGCAGUUGGUUGCCCU UAGCCUGAGGCAUUUAAUGC ACUCGGGAAGUACCUUUUCU CA (SEQ ID NO: 640) | GAAA (SEQ ID NO: 623) | AGGUACA UCCAAC (SEQ ID NO: 641) | CGUGCUGU UUCCUCCC CACG (SEQ ID NO: 635) | AUGGGGCAGUUGGUUGCCCUUAGCCUGAGGCAUU UAAUGCACUCGGGAAGUACCUUUUCUCAGAAAAG GUACAUCCAACCGUGCUGUUUCCUCCCCACG (SEQ ID NO: 642) |
| 23 | AUGGGGCAGUUGGUUGCCCU UAGCCUGAGGCAUUUAAUGC ACUCGGGAAGUACCUUUUCU CA (SEQ ID NO: 640) | GAAA (SEQ ID NO: 623) | CCAAC (SEQ ID NO: 643) | UCUAGGCG CCCGCUAA GUUC (SEQ ID NO: 629) | AUGGGGCAGUUGGUUGCCCUUAGCCUGAGGCAUU UAAUGCACUCGGGAAGUACCUUUUCUCAGAAACC AACUCUAGGCGCCCGCUAAGUUC (SEQ ID NO: 644) |

Example 18: Activation of Gene Expression with CasLambda Fusion (CRISPRa)

Figure 8A:
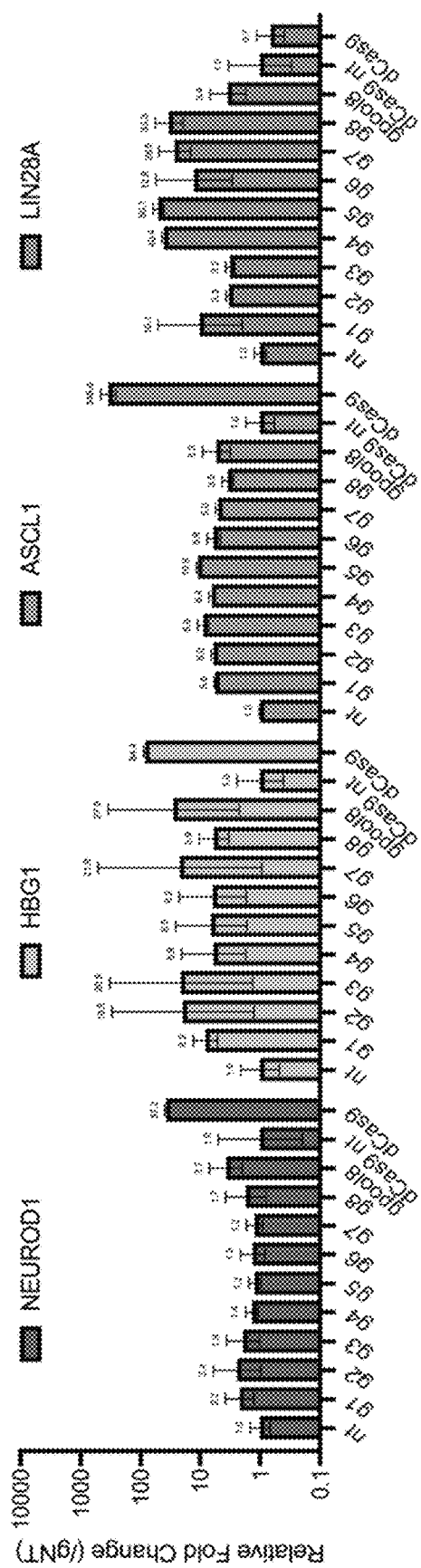
FIGS. 8A-8D illustrate change in gene expression of NEUROD1, HBG1, ASCL1, and LIN28A by different VPR-CasM fusions.
Figure 8B:
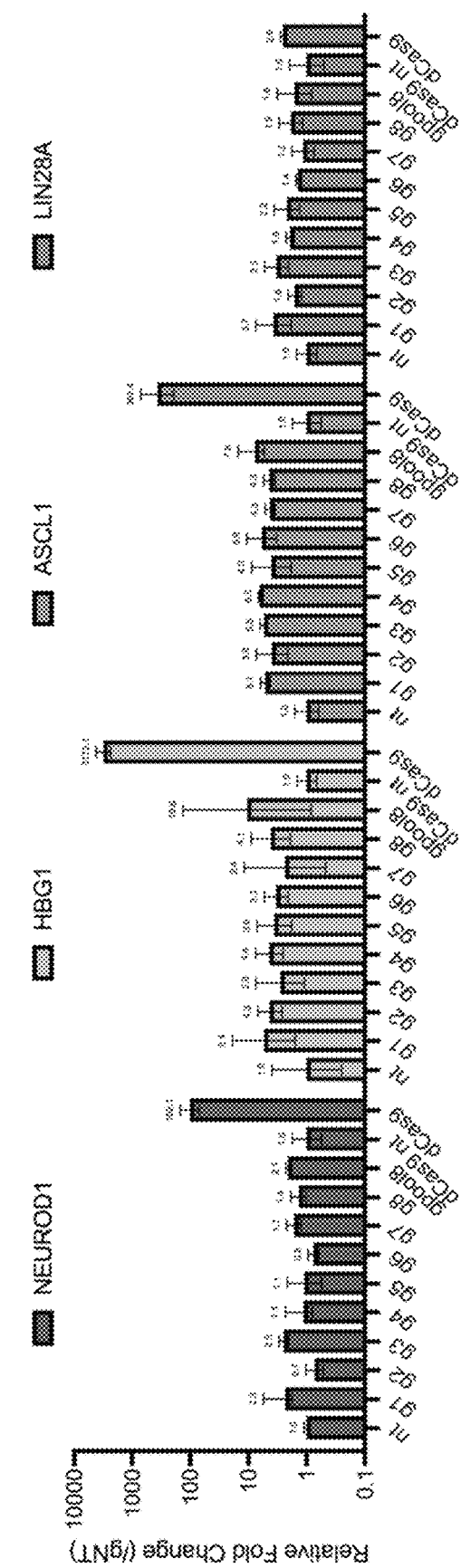
Figure 8C:
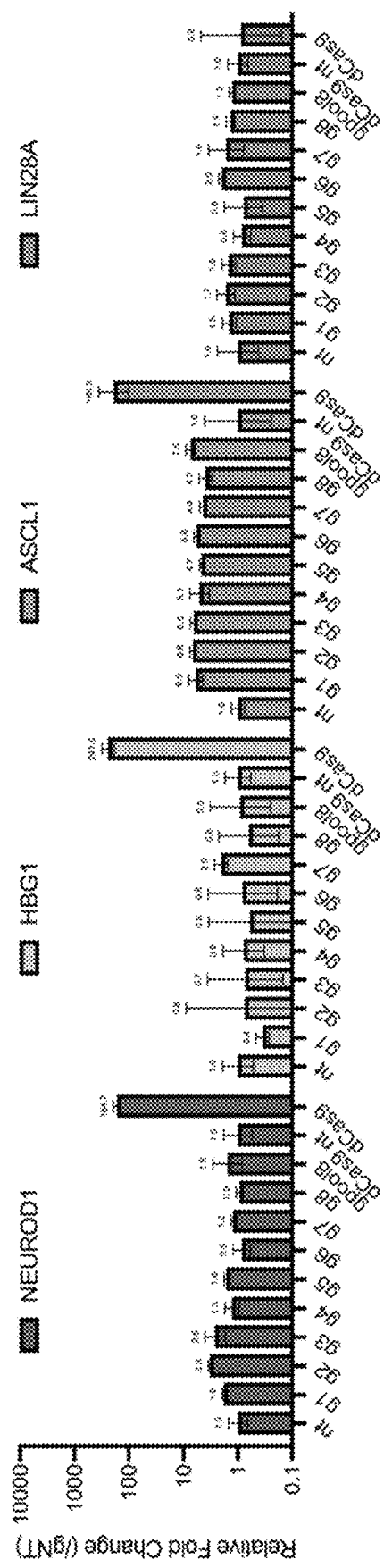
Figure 8D:
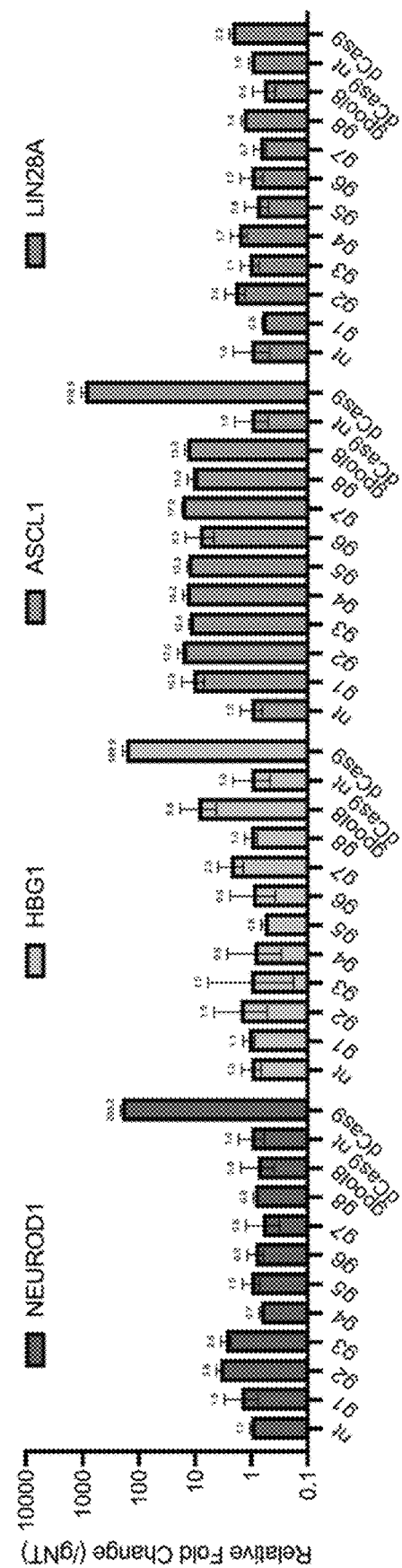

Multiple gene targets, including NEUROD1, HBG1, ASCL1, and LIN28A, were selected for testing the ability of VPR-CasM fusions to increase endogenous gene expression. A nucleic acid vector encoding VPR (SEQ ID NO: 300) was fused to catalytically inactive CasM proteins at their N' terminus with an XTEN10 linker (GSPAGSPTST SEQ ID NO: 711) and at least one CasM gRNA targeting an endogenous gene were introduced to cells via lipofection. Relative amounts of RNA, indicative of relative gene expression, were quantified with RT-qPCR. An increase of gene expression was observed with individual different gRNAs. A scramble sequence spacer (nt), and a pooled sample were used as negative controls. A catalytically inactive "dead" Cas9 fusion, dCas9, was included as a positive control. The fusion proteins were tested for their ability to increase expression in NEUROD1, HBG1, ASCL1, and LIN28A by different VPR-CasM fusions. FIG. 8A shows the change in gene expression by CasM.286251 (D267A) (SEQ ID NO: 728) with an N terminal VPR fused by an XTEN10 linker, which demonstrated upregulation with guides 1-8 for ASCL1, HBG1 and LIN28A relative to the scrambled sequence control. FIG. 8B shows the change in gene expression by CasM.19952 (D267A) (SEQ ID NO: 729) with an N terminal VPR fused by an XTEN10 linker, which demonstrated upregulation with guides 1-8 for ASCL1 and HBG1 and guide 3 for NEUROD1 relative to the scrambled sequence control. FIG. 8C showed the change in gene expression by CasM.19952 (D267N) (SEQ ID NO: 730) with an N terminal VPR fused by an XTEN10 linker, which demonstrated upregulation with guides 1-8 for ASCL1 and guides 2-3 for NEUROD1 relative to the scrambled sequence control. FIG. 8D showed the change in gene expression by CasM.19952 (E363Q) (SEQ ID NO: 731) with an N terminal VPR fused by an XTEN10 linker, which demonstrated upregulation with guides 1-8 for ASCL1 and guides 2-3 for NEUROD1 relative to the scrambled sequence control. The PAM sequence for the CasM 19952 enzymes was NTCG (SEQ ID NO: 369) comprising the repeat sequence of: UGGGGCAGUUGGUUGCCCUU AGCCUGAGGCAUUUAUUGCACUCGGGAAGUAC- CAUUU CUCAGAAAUGGUACAUCCAAC (SEQ ID NO: 645). The PAM sequence for the CasM 286251 enzymes was RTTR (SEQ ID NO: 370) comprising the repeat sequence of: AUGGGGCAGUUGGUUGCCCUU AGCCUGAGGAAUUUAAUUCACUCGGGAAGUACC- UUU CUCAUGAAAUGGUACAUCCAAC (SEQ ID NO: 646). Table 26 denotes the spacer sequence for the designated guide IDs in the FIGS. 8A-8D, the gene target, and the type of nucleases tested. The results show the catalytically inactive CasM proteins fused to VPR can increase the expression of genes.

TABLE 26

Guide sequences for Activation of Gene Expression

| ID in FIGs 8A-8D | Spacer sequence | | Gene target | Nucleases |
|---|---|---|---|---|
| g1 | CCCCCCACUCCCCGCUGCUG | (SEQ ID NO: 647) | ASCL1 | CasM.19952 |
| g2 | AAGUGGCAUCCUCUCUGAGC | (SEQ ID NO: 648) | ASCL1 | CasM.19952 |
| g3 | CUUCCUCGUCUGCAGCCACA | (SEQ ID NO: 649) | ASCL1 | CasM.19952 |
| g4 | ACUUUUCCUGUUUUCUCUCU | (SEQ ID NO: 650) | ASCL1 | CasM.19952 |
| g5 | GGUUCCUCGGUGACCCUAGA | (SEQ ID NO: 651) | ASCL1 | CasM.19952 |
| g6 | GUGACCCUAGAAAUUGGAGC | (SEQ ID NO: 652) | ASCL1 | CasM.19952 |
| g7 | UCUGCAGCCACAGAAUAUGG | (SEQ ID NO: 653) | ASCL1 | CasM.19952 |
| g8 | AGGAGCCACAGAGCAUUGAG | (SEQ ID NO: 654) | ASCL1 | CasM.19952 |
| g1 | GAGGAGGGCGGGAGACGAGC | (SEQ ID NO: 655) | NEUROD1 | CasM.19952 |
| g2 | UCUCCCGCCCUCCUCCGACA | (SEQ ID NO: 656) | NEUROD1 | CasM.19952 |
| g3 | CCAGUUAGAGACUCCGCGGA | (SEQ ID NO: 657) | NEUROD1 | CasM.19952 |
| g4 | CUCUGAUCUAGACCUAGUUA | (SEQ ID NO: 658) | NEUROD1 | CasM.19952 |
| g5 | CGCCGGAAGUAGGACAGAGG | (SEQ ID NO: 659) | NEUROD1 | CasM.19952 |
| g6 | AAAGGAGCGAGGACUCUUCA | (SEQ ID NO: 660) | NEUROD1 | CasM.19952 |
| g7 | CUCCUUUCGAUUUCUUGUCC | (SEQ ID NO: 661) | NEUROD1 | CasM.19952 |
| g8 | AUUUCUUGUCCUGACACUGG | (SEQ ID NO: 662) | NEUROD1 | CasM.19952 |
| g1 | GAACAAGGCAAAGGCUAUAA | (SEQ ID NO: 663) | HBG1 | CasM.19952 |
| g2 | AGUUAUAAUAGUGUGUGGAC | (SEQ ID NO: 664) | HBG1 | CasM.19952 |
| g3 | AAUAUUAGUGUACUUUAGAC | (SEQ ID NO: 665) | HBG1 | CasM.19952 |
| g4 | UUGAGCCCCUUCCUCGCUGC | (SEQ ID NO: 666) | HBG1 | CasM.19952 |
| g5 | AAGGUACAUGUGCAGGAUGU | (SEQ ID NO: 667) | HBG1 | CasM.19952 |
| g6 | GCAACCAGUAGCCCUUGCGU | (SEQ ID NO: 668) | HBG1 | CasM.19952 |
| g7 | CACUUUCUUUCUUUGUCCUU | (SEQ ID NO: 669) | HBG1 | CasM.19952 |
| g8 | GUGUUCAGUGGAUUAGAAAC | (SEQ ID NO: 670) | HBG1 | CasM.19952 |
| g1 | GAGAAGAAGCUGCUACAUCU | (SEQ ID NO: 671) | LIN28A | CasM.19952 |
| g2 | UUAACAAAUAUUAUUAGCAG | (SEQ ID NO: 672) | LIN28A | CasM.19952 |
| g3 | UCCUACCCCCACCCCAUCCC | (SEQ ID NO: 673) | LIN28A | CasM.19952 |
| g4 | GAGAUGGACAAUGGCCCGGG | (SEQ ID NO: 674) | LIN28A | CasM.19952 |
| g5 | CUCCGUGUACCUCUGUUCCU | (SEQ ID NO: 675) | LIN28A | CasM.19952 |
| g6 | GUGGAGAAGAUUGAAUUCAG | (SEQ ID NO: 676) | LIN28A | CasM.19952 |
| g7 | UACGGGUGCUCUCCAAGAA | (SEQ ID NO: 677) | LIN28A | CasM.19952 |
| g8 | UGGGGUAAAAGGACAAGAG | (SEQ ID NO: 678) | LIN28A | CasM.19952 |
| g1 | AAAAGGCGGACGCACUCCGG | (SEQ ID NO: 679) | ASCL1 | CasM.286251 |
| g2 | GGGGAGGGACUCCGUCCAGA | (SEQ ID NO: 680) | ASCL1 | CasM.286251 |
| g3 | GAGACCAUAUUCUGUGGCUG | (SEQ ID NO: 681) | ASCL1 | CasM.286251 |
| g4 | AGGUGUAUAGGUGGAAAGAC | (SEQ ID NO: 682) | ASCL1 | CasM.286251 |
| g5 | UUCUCUUCGGGUUCCUCGGU | (SEQ ID NO: 683) | ASCL1 | CasM.286251 |

TABLE 26-continued

Guide sequences for Activation of Gene Expression

| ID in FIGs 8A-8D | Spacer sequence | | Gene target | Nucleases |
|---|---|---|---|---|
| g6 | GAGCAAAUUACGAUUGAAGU | (SEQ ID NO: 684) | ASCL1 | CasM.286251 |
| g7 | CGAUUGAAGUUUAGAAACAU | (SEQ ID NO: 685) | ASCL1 | CasM.286251 |
| g8 | AAGUUUAGAAACAUGGUUGG | (SEQ ID NO: 686) | ASCL1 | CasM.286251 |
| g1 | UCGGAGGAGGGCGGGAGACG | (SEQ ID NO: 687) | NEUROD1 | CasM.286251 |
| g2 | AUCUCUCCUGCGGGUAAAAA | (SEQ ID NO: 688) | NEUROD1 | CasM.286251 |
| g3 | GCUUUUCCCUUCCUUCCCUC | (SEQ ID NO: 689) | NEUROD1 | CasM.286251 |
| g4 | ACAUUAGCUUUUCCCUUCCU | (SEQ ID NO: 690) | NEUROD1 | CasM.286251 |
| g5 | ACUAGGUCUAGAUCAGAGCG | (SEQ ID NO: 691) | NEUROD1 | CasM.286251 |
| g6 | GCGCCAAAGGAUGGCUUCUC | (SEQ ID NO: 692) | NEUROD1 | CasM.286251 |
| g7 | GGAGAAGCCAUCCUUUGGCG | (SEQ ID NO: 693) | NEUROD1 | CasM.286251 |
| g8 | GGGAACUAAUCUCAACGCUG | (SEQ ID NO: 694) | NEUROD1 | CasM.286251 |
| g1 | GUCAAGUUUGCCUUGUCAAG | (SEQ ID NO: 695) | HBG1 | CasM.286251 |
| g2 | GCCAGCCUUGCCUUGACCAA | (SEQ ID NO: 696) | HBG1 | CasM.286251 |
| g3 | GUCAAGGCAAGGCUGGCCAA | (SEQ ID NO: 697) | HBG1 | CasM.286251 |
| g4 | AGAUAGUGUGGGAAGGGGC | (SEQ ID NO: 698) | HBG1 | CasM.286251 |
| g5 | GCAGUGGUUUCUAAGGAAAA | (SEQ ID NO: 699) | HBG1 | CasM.286251 |
| g6 | GAGAAAACUGGAAUGACUG | (SEQ ID NO: 700) | HBG1 | CasM.286251 |
| g7 | GUACAUGCUUUAGCUUUAAA | (SEQ ID NO: 701) | HBG1 | CasM.286251 |
| g8 | AGAGAUAAUGGCAAAAGUCA | (SEQ ID NO: 702) | HBG1 | CasM.286251 |
| g1 | GUUCGGAGAAGAAGCUGCUA | (SEQ ID NO: 703) | LIN28A | CasM.286251 |
| g2 | UGCGGGGGAAGAUGUAGCAG | (SEQ ID NO: 704) | LIN28A | CasM.286251 |
| g3 | UCUUUUAGAAUUUGGGAGCC | (SEQ ID NO: 705) | LIN28A | CasM.286251 |
| g4 | GGUCAUUGUCUUUUAGAAUU | (SEQ ID NO: 706) | LIN28A | CasM.286251 |
| g5 | UGGGGGAGGGCCGGAGCUGG | (SEQ ID NO: 707) | LIN28A | CasM.286251 |
| g6 | UGCGUGUGGGGAGGGGGUGU | (SEQ ID NO: 708) | LIN28A | CasM.286251 |
| g7 | GGGGAGGGAGGUGUGAGCCU | (SEQ ID NO: 709) | LIN28A | CasM.286251 |
| g8 | GCCAGCGCCGCCAGGCUCAC | (SEQ ID NO: 710) | LIN28A | CasM.286251 |

Example 19: Base Editing with Dead CasM.19952 Variants—Deaminase Fusion Proteins Multiple nucleic acid vectors encoding the catalytically inactive variant dCasM.19952 fusion protein (SEQ ID NO: 729 (dCasM.19952 (D267A)) were constructed as shown in FIG. 9 and assessed for base editing activity. These fusion proteins comprised a catalytically inactive variant dCasM.19952 (D267A) SEQ ID NO: 729, also referred to as "dead CasM" of the active CasM.19952 (SEQ ID NO: 23), and were fused to either ABE8e (SEQ ID NO: 713), ABE8.20m (SEQ ID NO: 714), APOBEC3, (SEQ ID NO: 732) or AncBE4Max (SEQ ID NO: 733), via an XTEN10 linker (GSPAGSPTST SEQ ID NO: 711), an XTEN40 (GSPAGSPTSTEEGTSESATPESGPGTSTEPSEGSA PGSPA SEQ ID NO: 734), or an XTEN80 linker (GSPAGSPTSTEEGTSESATPESGPGTSTEPSEGSAPG SPAGSPTSTEEGTSTEPSEGSAPGTSTEP SEGSAPGTS-ESATP SEQ ID NO: 735) The base editing effector sequences can be found in Table 27. These vectors also encoded an amino acid sequence containing a nuclear localization signal (PKKKRKV; SEQ ID NO: 712) fused to the dead CasM.19952. Guides with no effectors served as negative controls comprising no deaminase, or base editing function. Target sequences included sequences located in the genes for B2M, TRAC, CIITA, or NGCG_B2M. Guide RNA spacers sequences and their respective targets are provided in Table 28. Cells were transfected with the nucleic acid vectors and guide RNAs. After sufficient incubation, DNA was extracted from the transfected cells. Target sequences were PCR amplified and sequenced by NGS and MiSeq. The presence of base modifications was analyzed from sequencing data after subtraction of background editing (using the no deaminase control). FIG. 9 shows the indel percentage of (catalytically active) CasM.19952 and gRNAs at respective target sites.

Figure 10A:
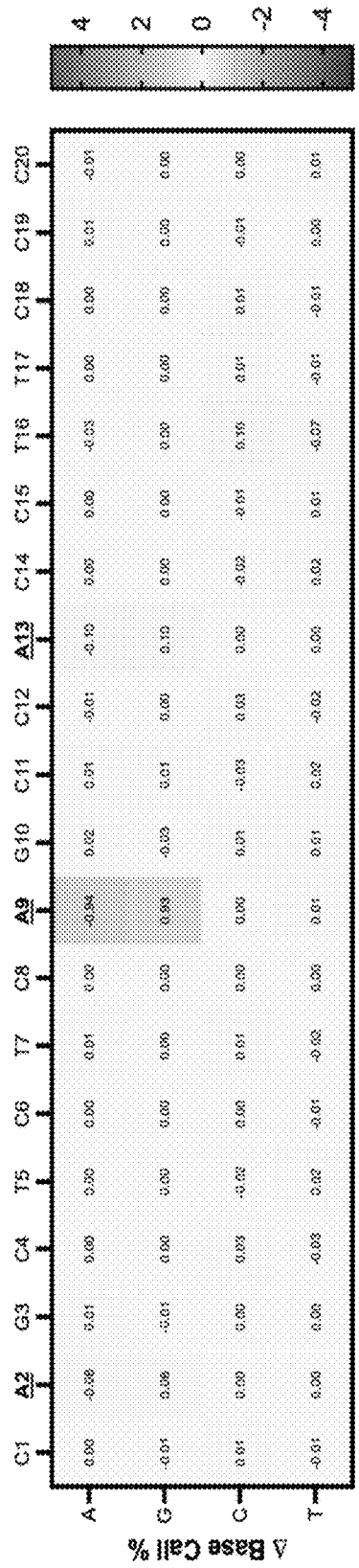
FIGS. 10A-10B illustrate a change in base call percent along the spacer sequence for the CIITA t26 target. The upper X-axis shows the target sequence along the spacer and the Y-axis shows the % change in base call per nucleotide.
Figure 10B:
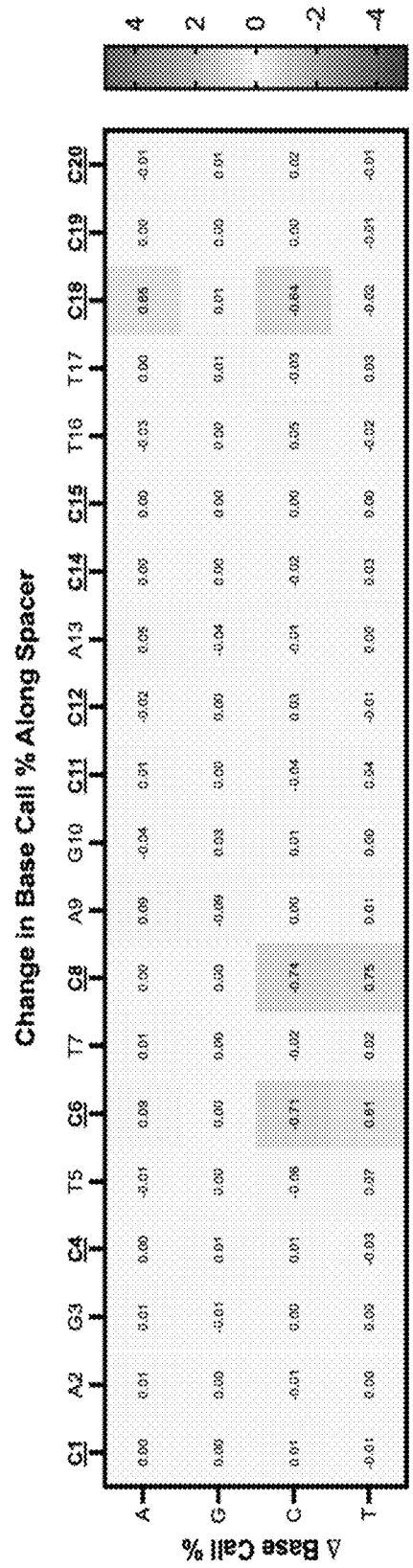

Designs with observed based editing is shown in Table 29. Editing was observed in the CIITA_26, CIITA_1, and TRAC_5 targets. Little to no editing was observed in the B2M_5, CIITA_12, CIITA_19, CIITA_6, TRAC_1, TRAC_3, CIITA_15, NGCG_B2M_3, CIITA_9, and CIITA 20 targets. The rows in Table 29 show distinct fusion protein designs (for example, APOBEC3 (base editor) fused via a C-XTEN80 linker to dCasM.19952). The columns represent distinct guide RNA spacer sequences from Table 28. The bases where editing was observed are represented as the position within the spacer and shown under the guide RNAs. The bases in parentheses indicate bases where editing was not observed. These bases are either the next closest base to the observed edited bases or any bases near the putative editing window. The prefix + indicates number of positions after the spacer sequence. FIG. 10A and FIG. 10B shows the change in base call percentage along the spacer sequence for the CIITA t26 target. The spacer sequence is shown on the upper X-axis and the change in base call is shown in the Y-axis. FIG. 10A shows an about 1% base change in position A9 to a G base with the construct ABE8e-XTEN10-dCasM.19952(D267A). FIG. 10B shows an about 0.70%-0.75% base change in position C6 and C8 to a T base with the construct AncBE4Max-XTEN10-dCasM.19952 (D267A). The results show dCasM.19952 can be fused with a base editing enzyme to generate base edits in a sequence.

TABLE 28

Guide Spacer Sequences for Base Editing

| Target | Spacer | |
|---|---|---|
| B2M_5 | CUCCGUGGCCUUAGCUGUGC | (SEQ ID NO: 715) |
| CIITA_1 | GUGAGGAAGCACCUGAGCCC | (SEQ ID NO: 716) |
| CIITA_12 | CUGCAUCCCUGCUCAGGCUA | (SEQ ID NO: 717) |
| CIITA_19 | UCCUGGAGAGAACAGGCAAU | (SEQ ID NO: 718) |
| CIITA_26 | CAGCUCUCAGCCACCUUCCC | (SEQ ID NO: 719) |
| CIITA_6 | GGACCUAAAGAAACUGGAGU | (SEQ ID NO: 720) |
| TRAC_1 | ACCAGCUUGACAUCACAGGA | (SEQ ID NO: 721) |
| TRAC_3 | GAACCCAAUCACUGACAGGU | (SEQ ID NO: 722) |
| TRAC_5 | GUGAAUAGGCAGACAGACUU | (SEQ ID NO: 723) |
| CIITA_15 | CAGAUGCAGUUAUUGUACAA | (SEQ ID NO: 724) |
| NGCG_B2M_3 | CGAGCACAGCUAAGGCCACG | (SEQ ID NO: 725) |
| CIITA_9 | CUCCAUCAGCCACUGACCUG | (SEQ ID NO: 726) |
| CIITA_20 | GGGACGAGGGUGUCUCGCAG | (SEQ ID NO: 727) |

TABLE 29

Constructs with observed based editing in target sequences

| Construct | CIITA_26 | CIITA_1 | TRAC_5 |
|---|---|---|---|
| APOBEC3 C-XTEN80 | C6 (C4, C8) | | |
| BE4Max N-XTEN10 | C6, C8 (C4, C11) | | |
| ABE8e N-XTEN10 | A9 (A2, A13) | A8 (A7, A11) | A7 (A5, A11) |
| BE4Max N-XTEN40 | C6 (C4, C8) | | |
| ABE8e N-XTEN40 | A9 (A2, A13) | | |
| APOBEC3 N-XTEN80 | C6 (C4, C8) | | |
| ABE8e N-XTEN80 | A9, A13 (A2, A + 3) | | |

TABLE 27

Fusion effector sequences

| Name | SEQ ID NO: | Sequence |
|---|---|---|
| ABE8e (base editor) | 713 | SEVEFSHEYWMRHALTLAKRARDEREVPVGAVLVLNNRVIGE GWNRAIGLHDPTAHAEIMALRQGGLVMQNYRLIDATLYVTFE PCVMCAGAMIHSRIGRVVFGVRNSKRGAAGSLMNVLNYPGM NHRVEITEGILADECAALLCDFYRMPRQVFNAQKKAQSSIN |
| ABE8.20m (base editor) | 714 | SEVEFSHEYWMRHALTLAKRARDEREVPVGAVLVLNNRVIGE GWNRAIGLHDPTAHAEIMALRQGGLVMQNYRLYDATLYSTFE PCVMCAGAMIHSRIGRVVFGVRNAKTGAAGSLMDVLHHPGM NHRVEITEGILADECAALLCRFFRMPRRVFNAQKKAQSSTD |
| APOBEC3 (base editor) | 732 | EASPASGPRHLMDPHIFTSNFNNGIGRHKTYLCYEVERLDNGTS VKMDQHRGFLHNQAKNLLCGFYGRHAELRFLDLVPSLQLDPA QIYRVTWFISWSPCFSWGCAGEVRAFLQENTHVRLRIFAARIYD YDPLYKEALQMLRDAGAQVSIMTYDEFKHCWDTFVDHQGCP FQPWDGLDEHSQALSGRLRAILQNQGN |
| AncBE4Max (base editor) | 733 | SSETGPVAVDPTLRRRIEPHEFEVFFDPRELRKETCLLYEIKWGT SHKIWRHSSKNTTKHVEVNFIEKFTSERHFCPSTSCSITWFLSWS PCGECSKAITEFLSQHPNVTLVIYVARLYHHMDQQNRQGLRDL VNSGVTIQIMTAPEYDYCWRNFVNYPPGKEAHWPRYPPLWMK LYALELHAGIGLPPCLNILRRKQPQLTFFTIALQSCHYQRLPPH ILWATGLK |

Example 20: CasM.19952 Sequence Homology

It is well known that sequence diversity is a characteristic of CRISPR/Cas systems and that effector proteins can exhibit low levels of sequence identity yet belong to the same class, type or subtype of CRISPR effector protein. To assess sequence diversity between the D2S effector proteins, the sequences of the effector proteins were aligned using pairwise MUSCLE alignment. Each aligned sequence was compared to the CasM.19952 (SEQ ID NO: 23) aligned sequence. As shown in Table 30, 19 of the D2S effector proteins are at least 75% identical to CasM.19952.

TABLE 30

Sequence alignment of D2S effector proteins

| SEQ ID NO | Effector protein name | Identity to CasM.19952 |
| --- | --- | --- |
| 23 | CasM.19952 | 100.00 |
| 26 | CasM.288480 | 96.15 |
| 24 | CasM.274559 | 94.66 |
| 208 | CasM.272451 | 92.31 |
| 222 | CasM.289248 | 84.19 |
| 28 | CasM.289206 | 84.19 |
| 29 | CasM.290598 | 83.97 |
| 217 | CasM.287826 | 83.76 |
| 229 | CasM.294406 | 82.09 |
| 25 | CasM.286251 | 81.88 |
| 30 | CasM.290816 | 81.74 |
| 219 | CasM.287936 | 81.66 |
| 207 | CasM.270012 | 81.41 |
| 32 | CasM.295231 | 81.10 |
| 202 | CasM.19498 | 79.96 |
| 220 | CasM.288450 | 79.32 |
| 205 | CasM.19948 | 78.63 |
| 34 | CasM.279423 | 78.42 |
| 31 | CasM.295071 | 78.21 |
| 27 | CasM.288668 | 75.43 |
| 213 | CasM.285333 | 61.65 |
| 225 | CasM.290380 | 60.91 |
| 216 | CasM.287128 | 60.63 |
| 215 | CasM.286678 | 59.47 |
| 22 | CasM.19924 | 53.73 |

Example 21: D2S Effector Protein Motif Analysis

The MEME algorithm (Multiple EM for Motif Elicitation, Bailey & Elkan, 1994) was used to identify sequence motifs that are shared by D2S effector proteins (SEQ ID Nos 1-45 and 202-240). The analysis was performed using the default parameters. This analysis identified the seven highly conserved motifs that are shown in FIG. 11A. The number of analyzed sequences that include the motifs is provided in Table 31 along with the length of each motif

TABLE 31

D2S motif analysis

| Motif ID | Number of sequences that include the motif (out of 84) | Motif length |
| --- | --- | --- |
| MEME_1 | 79 | 50 |
| MEME_2 | 81 | 29 |
| MEME_3 | 80 | 21 |
| MEME_4 | 30 | 41 |
| MEME_5 | 77 | 21 |
| MEME_6 | 76 | 15 |
| MEME_7 | 82 | 23 |

The weblogos in FIG. 11A provide multilevel consensus sequences. Weblogos corresponding to MEMS_1, MEME_2, MEME_3, MEMS 4, MEME_5, MEME_6 and MEME_7 are shown in FIG. 11A. This multilevel sequence analysis of the weblogos in FIG. 11A was used to generate the PROSITE motifs shown in Table 32. In Table 32, the brackets indicate amino acids in the alternative, for example [KG] means K or G. In another example [VFL] means V, F, or L. PROSITE motifs are routinely used in the art to conveniently illustrate consensus motifs.

TABLE 32

D2S PROSITE motifs

| Motif ID | PROSITE motif | SEQ ID NO |
| --- | --- | --- |
| MEME_1 | [KG][ET]F[VFL][LG][RK]NW[SRT]Y[YF][EDQ]LQ[NT][MK]I[EK]YKA[KA]E[YA]GIKV[VE][KY][IV][NR]P[AK]YTS[QRK][RT]CS[WK]CG[YQH]I[GD][KF][RD][NF] | 793 |
| MEME_2 | T[QL]NH[LRQ][YF]SR[EA][VL][IV][DEN][FY]AVK[NH]GA[GA]TI[QH]ME[DN]LSG | 794 |
| MEME_3 | L[ND][KP][NKE][IK][VI][VL]GVDLG[IV][NS][VY]P[LA]Y[AV][AS][TV] | 795 |
| MEME_4 | QW[GN]LLYHINDNLY[KR]AANNISSKLYLD[DE]HVSSMVR[LM]KH[AD]EYL | 796 |
| MEME_5 | V[LK]RG[EK]R[SA][IL][PR][NTS][YF][KR][KS][GDN][MQ]P[IL]P[FI][HP][WC] | 797 |
| MEME_6 | [NH]ADYNA[AS][RQ]N[IL][AS][IN][SK][KD][ID] | 798 |
| MEME_7 | [RY][LC][GK][GT][TG]R[GI]G[HK]GRK[KR][KR]LEP[LI][EY][RK]L[RE][DG] | 799 |

Figure 11B:
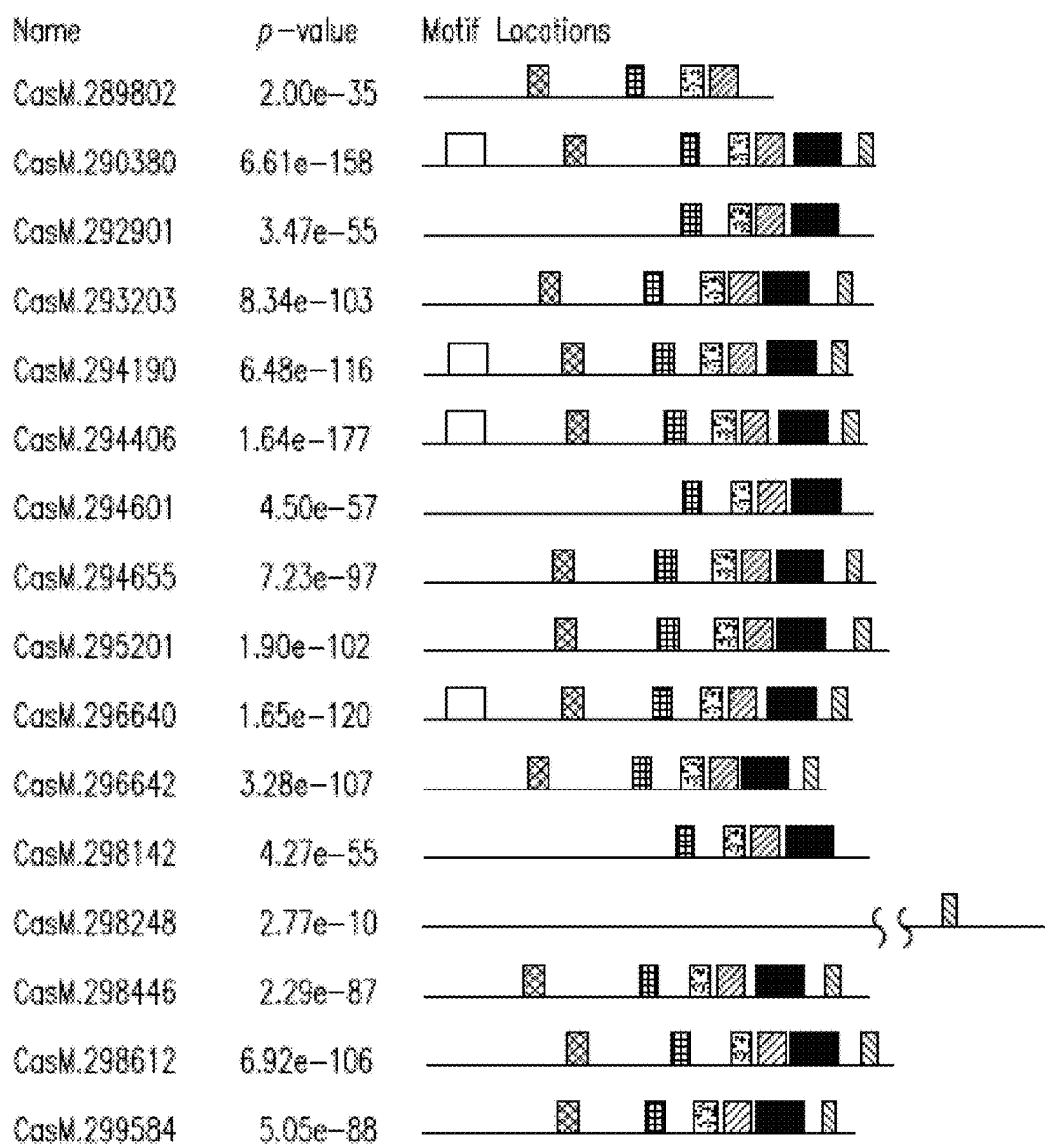

The location of the detected motifs in the effector proteins is illustrated in FIG. 11B. All motifs illustrated in FIG. 11B shared at least 36.5% identity to the PROSITE sequences shown in Table 32. In general, MEME_4 and MEME_5 are located in the N terminal half of the effector protein. In general, MEME_1, MEME_2, MEME_6, and MEME_7 are located in the C terminal half of the effector protein. In general, the order of MEMEs from N terminus to C terminus is: MEME_4, MEME_5, MEME_3, MEME_7, MEME_2, MEME_1, MEME_6.

In general, the motifs demonstrate a similar distribution in all D2S effector domains shown in FIG. 11B, namely MEME_4, MEME_5, MEME_3, MEME_7, MEME_2, MEME_1 and MEME_6 (from N- to C-terminus). All seven motifs were identified in a lot of the effector proteins shown in FIG. 11B. However, all seven motifs are not always identified in the effector proteins. For example, in some instances, MEME_4 was not identified, but the effector protein includes MEME_5, MEME_3, MEME_7, MEME_2, MEME_1 and MEME_6 (from N- to C-terminus) e.g. for CasM.298706.

The degree of identity of PROSITE motifs MEME_1 to MEME_7 in the D2S effector proteins that share greater than 75% identity with CasM.19952 was calculated. In calculating these degrees of identity, each alternative in a prosite motif was given an equal weight. For example, both NAD or HAD share 100% identity with the prosite motif [NH]AD. The output from this identity analysis is shown in Table 33.

MEME_1 to MEME_7. All effector proteins described in Table 33 comprise an amino acid sequence that is at least 72% identical to each of MEME_1 to MEME_6. All effector proteins described in Table 33 comprise an amino acid sequence that is at least 90% identical to each of MEME_1, and MEME_3 to MEME_6.

MEME_4 was found to be a particularly useful motif for identifying the group of D2S effector proteins and distinguishing these D2S effector proteins from previously known effector proteins. All effector proteins described in Table 33 comprise an amino acid sequence that is at least 90% identical to MEME_4. In some cases, the D2S effector proteins include an amino acid sequence that is at least 37% identical to MEME4.

Example 22: D2S Enzyme Edit Genomic DNA in Mammalian Cells

D2S effectors were tested for their ability to produce indels in HEK293T cells. Briefly, 300 ng of plasmids expressing effector and gRNA were delivered by lipofection to HEK293T cells in 96 well plates using TransIT-293 reagent at the ratio of 2:1 lipid:DNA. Cells were incubated for 3 days before being lysed and subjected to PCR amplification. Indels were detected by next generation sequencing of PCR amplicons at the targeted loci and indel percentage was calculated as the fraction of sequencing reads containing insertions or deletions relative to an unedited reference sequence. Sequencing libraries with less than 20% of reads aligning to the reference sequence were excluded from the analysis for quality control purposes. “No plasmid” and CasM.19952 (SEQ ID NO: 23) were included as negative and positive controls, respectively. TABLE 34 shows the results of this experiment. TABLE 34 describes the sgRNA sequences with and without spacer tested and percent of reads with indels. Additionally, TABLE 34 shows the composition tested, and the effector protein Seq ID NO (under

TABLE 33 conservation of the D2S motifs

| Effector Protein | MEME_1 | MEME_2 | MEME_3 | MEME_4 | MEME_5 | MEME_6 | MEME_7 |
|---|---|---|---|---|---|---|---|
| CasM.19498 | 90 | 82.75862069 | 100 | 100 | 95.23809524 | 100 | 91.30434783 |
| CasM.19948 | 92 | 86.20689655 | 95.23809524 | 92.68292683 | 100 | 100 | 86.95652174 |
| CasM.19952 | 92 | 93.10344828 | 95.23809524 | 100 | 95.23809524 | 100 | 82.60869565 |
| CasM.270012 | 88 | 82.75862069 | 95.23809524 | 100 | 100 | 100 | 86.95652174 |
| CasM.272451 | 88 | 93.10344828 | 95.23809524 | 100 | 100 | 93.33333333 | 86.95652174 |
| CasM.274559 | 94 | 93.10344828 | 90.47619048 | 100 | 95.23809524 | 93.33333333 | 86.95652174 |
| CasM.279423 | 88 | 82.75862069 | 100 | 95.12195122 | 100 | 93.33333333 | 82.60869565 |
| CasM.286251 | 94 | 93.10344828 | 95.23809524 | 97.56097561 | 100 | 93.33333333 | 82.60869565 |
| CasM.287826 | 90 | 89.65517241 | 100 | 97.56097561 | 95.23809524 | 100 | 86.95652174 |
| CasM.287936 | 94 | 93.10344828 | 95.23809524 | 97.56097561 | 100 | 93.33333333 | 78.26086957 |
| CasM.288450 | 92 | 72.4137931 | 95.23809524 | 90.24390244 | 95.23809524 | 86.66666667 | 91.30434783 |
| CasM.288480 | 92 | 93.10344828 | 100 | 97.56097561 | 95.23809524 | 100 | 86.95652174 |
| CasM.288668 | 94 | 86.20689655 | 95.23809524 | 97.56097561 | 100 | 93.33333333 | 69.56521739 |
| CasM.289206 | 88 | 89.65517241 | 100 | 100 | 100 | 93.33333333 | 91.30434783 |
| CasM.289248 | 88 | 86.20689655 | 100 | 100 | 100 | 93.33333333 | 91.30434783 |
| CasM.290598 | 90 | 89.65517241 | 95.23809524 | 95.12195122 | 100 | 100 | 82.60869565 |
| CasM.290816 | 94 | 79.31034483 | 95.23809524 | 92.68292683 | 95.23809524 | 100 | 82.60869565 |
| CasM.294406 | 92 | 93.10344828 | 95.23809524 | 97.56097561 | 95.23809524 | 86.66666667 | 82.60869565 |
| CasM.295071 | 94 | 93.10344828 | 95.23809524 | 97.56097561 | 100 | 93.33333333 | 82.60869565 |
| CasM.295231 | 92 | 79.31034483 | 95.23809524 | 92.68292683 | 95.23809524 | 100 | 86.95652174 |

Table 33 shows that motifs MEME_1 to MEME_7 are highly conserved between D2S effector proteins that are at least 75% identical to CasM.19952. In particular, all effector proteins described in Table 33 comprise an amino acid sequence that is at least 69.5% or more identical to each of Enzyme Seq ID NO). The results in TABLE 34 show these D2S enzymes are capable of modifying a genome in mammalian cells. Collectively, these guides targeted PAM sequences as described in TABLE 35.

333

334

TABLE 34

Results of Indel experiment with D2S effectors

| Comp. | Enzyme SEQ ID NO | Indel Percent | sgRNA sequence with spacer | sgRNA sequence without spacer |
|---|---|---|---|---|
| PL8080 | 220 | 1.506 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACUCUAGGCGCCCGCUAAGUUC (SEQ ID NO: 736) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8082 | 220 | 1.273 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACGGACAAAGUUUAGGGCGUCG (SEQ ID NO 738) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8083 | 220 | 1.287 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACAUAAGCGUCAGAGCGCCGAG (SEQ ID NO 739) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8086 | 220 | 0.861 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACCUCCGUGGCCUUAGCUGUGC (SEQ ID NO 740) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8087 | 220 | 9.254 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACGAUGGAUGAAACCCAGACAC (SEQ ID NO 741) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8090 | 220 | 3.132 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACUGAUGAUUCUGCCCUCCUCC (SEQ ID NO 742) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8091 | 220 | 9.643 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACAGUACAUCUUCAAGCCAUCC (SEQ ID NO 743) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8097 | 220 | 0.679 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACGACCUAAGGGAGAGCCAGGA (SEQ ID NO 744) | AAUAGGAUUUAUCCUAUGGGGCAGUUGGUUGCC CUUAGCCUGAGGCAUUUAUUGCACUCGGGAAGU ACCUUAUUUCAUUGAGCAACAGAAAGGGUACAU CCAAC (SEQ ID NO: 737) |
| PL8100 | 220 | 1.225 | AAUAGGAUUUAUCCUAUGGGGCAGUUGGUUGC CCUUAGCCUGAGGCAUUUAUUGCACUCGGGAA GUACCUUAUUUCAUUGAGCAACAGAAAGGGUA CAUCCAACGGAAGAUUCUGAUGUGGAAA(SEQ ID NO 745) | |
| PL8133 | 233 | 0.531 | GGGGCAGUUGGAUGCCCUUAUGCUGAGGGAUU AUUCCACUCGGCAAGUACCAAUAAUAAUGGAU GUGAAAAGGUACAUCCAACUGAGUGGGGCAGU GGGGGCG (SEQ ID NO 746) | GGGGCAGUUGGAUGCCCUUAUGCUGAGGGAUUA UUCCACUCGGCAAGUACCAAUAAUAAUGGAUGU GAAAAGGUACAUCCAAC (SEQ ID NO: 747) |
| PL8150 | 233 | 11.948 | GGGGCAGUUGGAUGCCCUUAUGCUGAGGGAUU AUUCCACUCGGCAAGUACCAAUAAUAAUGGAU GUGAAAAGGUACAUCCAACUCGGGGGGCGGGG GGGAGAA (SEQ ID NO 748) | GGGGCAGUUGGAUGCCCUUAUGCUGAGGGAUUA UUCCACUCGGCAAGUACCAAUAAUAAUGGAUGU GAAAAGGUACAUCCAAC (SEQ ID NO: 747) |
| PL8178 | 240 | 0.553 | CGGGUGGUUGCACAUCCGAAGGGUGAGGAUUU AUUCACUCACUAAUACUACAAAUGGAAAAAUU UAAGGAAAAUGUAAAUGCAACCUCACGUCAU CCAGCAGAGA (SEQ ID NO: 749) | CGGGUGGUUGCACAUCCGAAGGGUGAGGAUUUA UUCACUCACUAAUACUACAAAUGGAAAAAUUUA AGGAAAAUGUAAAUGCAAC (SEQ ID NO: 750) |
| PL8180 | 240 | 4.621 | CGGGUGGUUGCACAUCCGAAGGGUGAGGAUUU AUUCACUCACUAAUACUACAAAUGGAAAAAUU UAAGGAAAAUGUAAAUGCAACUUGUGCUGA GGAAGCUCAU (SEQ ID NO: 751) | CGGGUGGUUGCACAUCCGAAGGGUGAGGAUUUA UUCACUCACUAAUACUACAAAUGGAAAAAUUUA AGGAAAAUGUAAAUGCAAC (SEQ ID NO: 750) |

TABLE 34-continued

Results of Indel experiment with D2S effectors

| Comp. | Enzyme SEQ ID NO | Indel Percent | sgRNA sequence with spacer | sgRNA sequence without spacer |
|---|---|---|---|---|
| PL8185 | 240 | 3.863 | CGGGUGGUUGCACAUCCGAAGGGUGAGGAUUU AUUCACUCACUAAUACUACAAAUGGAAAAAUU UAAAGGAAAAUGUAAAUGCAACAUGAGAGCAA GUGGGCUGAU (SEQ ID NO: 752) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8186 | 240 | 2.340 | CGGGUGGUUGCACAUCCGAAGGGUGAGGAUUU AUUCACUCACUAAUACUACAAAUGGAAAAAUU UAAAGGAAAAUGUAAAUGCAACAGGUGGCAGC GGCUUGAUCC (SEQ ID NO: 753) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8187 | 240 | 3.144 | CGGGUGGUUGCACAUCCGAAGGGUGAGGAUUU AUUCACUCACUAAUACUACAAAUGGAAAAAUU UAAAGGAAAAUGUAAAUGCAACGCCAAAGGCA UGUGAGGUAC (SEQ ID NO: 754) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8192 | 240 | 6.771 | CGGGUGGUUGCACAUCCGAAGGGUGAGGAUUU AUUCACUCACUAAUACUACAAAUGGAAAAAUU UAAAGGAAAAUGUAAAUGCAACGGGCAGCUGG UGGAAUUUUU (SEQ ID NO: 755 ) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8194 | 240 | 12.361 | CGGGUGGUUGCACAUCCGAAGGGUGAGGAUUU AUUCACUCACUAAUACUACAAAUGGAAAAAUU UAAAGGAAAAUGUAAAUGCAACCAGGUUGAGA ACUUGUUGCU (SEQ ID NO: 756) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8195 | 240 | 4.499 | CGGGUGGUUGCACAUCCGAAGGGUGAGGAUUU AUUCACUCACUAAUACUACAAAUGGAAAAAUU UAAAGGAAAAUGUAAAUGCAACUCCCGACCCU CCCGUCGCCG (SEQ ID NO: 757) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8197 | 240 | 8.178 | CGGGUGGUUGCACAUCCGAAGGGUGAGGAUUU AUUCACUCACUAAUACUACAAAUGGAAAAAUU UAAAGGAAAAUGUAAAUGCAACGGACGAGCCU ACCCGUCCCC (SEQ ID NO: 758) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8198 | 240 | 1.089 | CGGGUGGUUGCACAUCCGAAGGGUGAGGAUUU AUUCACUCACUAAUACUACAAAUGGAAAAAUU UAAAGGAAAAUGUAAAUGCAACUCGGGGGGCG GGGGGGAGAA (SEQ ID NO: 759) | CGGGUGGUUGCACAUCCGAAGGGUGAGGAUUUA UUCACUCACUAAUACUACAAAUGGAAAAAUUUA AAGGAAAAUGUAAAUGCAAC (SEQ ID NO: 750) |
| PL8216 | 16 | 0.941 | UGAAAUAUUGAUUGAGGUCGCCGUUUACGUUG CGUCACAAGGGCGCGCGGGCGACCGAAGGCCG AUCUGUACGGCCUGCAGGUUGAGAAGGCACAU AUUAGAGGAGAAAUUGCUUCCCUUUGUGUUCG CUCACCGAGUAUUCCUUGUUAUUUGCGGCAAGA AACUGUCUUAAUUGUUUGAAAGGGUGCAUACA GGACCUCAAAUUCCUCCUCAGA (SEQ ID NO: 760) | UGAAAUAUUGAUUGAGGUCGCCGUUUACGUUGC GUCACAAGGGCGCGCGGGCGACCGAAGGCCGAUC UGUACGGCCUGCAGGUUGAGAAGGCACAUAUUA GAGGAGAAAUUGCUUCCCUUUGUGUUCGCUCACC GAGUAUUCCUUGUUAUUUGCGGCAAGAAACUGU CUUAAUUGUUUGAAAGGGUGCAUACAGG (SEQ ID NO: 761) |
| PL8240 | 14 | 0.620 | AAGCAACCGCGUACACGCGGACGAACGGCCGA CCUGCUCGGCCUGAAGGUUGAGAAGGUUAUGU AUAAGAGGAGAAAUCCCCCUUCAUAAUCGCU CACCAAGCUCCCAAUUUACAUAUUUUGAAAGG GCGCAUGCAGGACCUCAAAUUCCUCCUCAGA (SEQ ID NO: 762) | AAGCAACCGCGUACACGCGGACGAACGGCCGACC UGCUCGGCCUGAAGGUUGAGAAGGUUAUGUAUA AGAGGAGAAAUCCCCCUUCAUAAUCGCUCACCA AGCUCCCAAUUUACAUAUUUUGAAAGGGCGCAU GCAGG (SEQ ID NO: 763) |
| PL8252 | 15 | 0.693 | UAUUGCGCUAGCCAUAAUGGCAAUCGCGUACA GGCAACUGAAGGCCGACCUGUACGGCCUUAAG GUUGAGAAGGCACAUGUAAGUGGAAAAAUGCU UUCCCGUUGUGUUCGCUCACCAAGCACACACG UUUGAAAUGUGGGGUGCUUACAGGAUCCAACA GCCAGGGGACU (SEQ ID NO: 764) | UAUUGCGCUAGCCAUAAUGGCAAUCGCGUACAG GCAACUGAAGGCCGACCUGUACGGCCUUAAGGU UGAGAAGGCACAUGUAAGUGGAAAAAUGCUUUC CCGUUGUGUUCGCUCACCAAGCACACACGUUUGA AAUGUGGGGUGCUUACAGG (SEQ ID NO: 765) |
| PL8253 | 15 | 1.435 | UAUUGCGCUAGCCAUAAUGGCAAUCGCGUACA GGCAACUGAAGGCCGACCUGUACGGCCUUAAG GUUGAGAAGGCACAUGUAAGUGGAAAAAUGCU UUCCCGUUGUGUUCGCUCACCAAGCACACACG UUUGAAAUGUGGGGUGCUUACAGGAUCCUGUG UGCCCUGAUGC (SEQ ID NO: 766) | UAUUGCGCUAGCCAUAAUGGCAAUCGCGUACAG GCAACUGAAGGCCGACCUGUACGGCCUUAAGGU UGAGAAGGCACAUGUAAGUGGAAAAAUGCUUUC CCGUUGUGUUCGCUCACCAAGCACACACGUUUGA AAUGUGGGGUGCUUACAGG (SEQ ID NO: 765) |
| PL8264 | 15 | 0.543 | UAUUGCGCUAGCCAUAAUGGCAAUCGCGUACA GGCAACUGAAGGCCGACCUGUACGGCCUUAAG GUUGAGAAGGCACAUGUAAGUGGAAAAAUGCU UUCCCGUUGUGUUCGCUCACCAAGCACACACG | UAUUGCGCUAGCCAUAAUGGCAAUCGCGUACAG GCAACUGAAGGCCGACCUGUACGGCCUUAAGGU UGAGAAGGCACAUGUAAGUGGAAAAAUGCUUUC CCGUUGUGUUCGCUCACCAAGCACACACGUUUGA |

TABLE 34-continued

Results of Indel experiment with D2S effectors

| Comp. | Enzyme SEQ ID NO | Indel Percent | sgRNA sequence with spacer | sgRNA sequence without spacer |
|---|---|---|---|---|
| | | | UUUGAAAUGUGGGGUGCUUACAGGACCUCAAA UUCCUCCUCAGA (SEQ ID NO: 767) | AAUGUGGGGUGCUUACAGG (SEQ ID NO: 765) |
| PL8272 | 239 | 3.642 | AGUAUGAGGCCGCCGAUAAACGUUUCGCUAGC CUGACAGGCAAUCGCGAACGGGCGGCUGAAGG CCGACCUGUACGGCCUGAAGGAUGAGAAGGCA CAUAUAAGUGGAAAAUUGCUUCCCGUUGUGUU CGCUCACCAGGUACUCCUUAAUUUGAAAGCUG CAAGAGCUCCUAAUUUGAGGGGUGCAUACAGG AGAAAGAGAGUAGCGCGA (SEQ ID NO: 768) | AGUAUGAGGCCGCCGAUAAACGUUUCGCUAGCC UGACAGGCAAUCGCGAACGGGCGGCUGAAGGCC GACCUGUACGGCCUGAAGGAUGAGAAGGCACAU AUAAGUGGAAAAUUGCUUCCCGUUGUGUUCGCU CACCAGGUACUCCUUAAUUUGAAAGCUGCAAGA GCUCCUAAUUUGAGGGGUGCAUACAGG (SEQ ID NO: 769) |
| PL8287 | 239 | 0.995 | AGUAUGAGGCCGCCGAUAAACGUUUCGCUAGC CUGACAGGCAAUCGCGAACGGGCGGCUGAAGG CCGACCUGUACGGCCUGAAGGAUGAGAAGGCA CAUAUAAGUGGAAAAUUGCUUCCCGUUGUGUU CGCUCACCAGGUACUCCUUAAUUUGAAAGCUG CAAGAGCUCCUAAUUUGAGGGGUGCAUACAGG UACUAUGGGAUCAAGCCGCU (SEQ ID NO: 770) | AGUAUGAGGCCGCCGAUAAACGUUUCGCUAGCC UGACAGGCAAUCGCGAACGGGCGGCUGAAGGCC GACCUGUACGGCCUGAAGGAUGAGAAGGCACAU AUAAGUGGAAAAUUGCUUCCCGUUGUGUUCGCU CACCAGGUACUCCUUAAUUUGAAAGCUGCAAGA GCUCCUAAUUUGAGGGGUGCAUACAGG (SEQ ID NO: 769) |
| PL8288 | 239 | 1.598 | AGUAUGAGGCCGCCGAUAAACGUUUCGCUAGC CUGACAGGCAAUCGCGAACGGGCGGCUGAAGG CCGACCUGUACGGCCUGAAGGAUGAGAAGGCA CAUAUAAGUGGAAAAUUGCUUCCCGUUGUGUU CGCUCACCAGGUACUCCUUAAUUUGAAAGCUG CAAGAGCUCCUAAUUUGAGGGGUGCAUACAGG ACCUCAAAUUCCUCCUCAGA (SEQ ID NO: 771) | AGUAUGAGGCCGCCGAUAAACGUUUCGCUAGCC UGACAGGCAAUCGCGAACGGGCGGCUGAAGGCC GACCUGUACGGCCUGAAGGAUGAGAAGGCACAU AUAAGUGGAAAAUUGCUUCCCGUUGUGUUCGCU CACCAGGUACUCCUUAAUUUGAAAGCUGCAAGA GCUCCUAAUUUGAGGGGUGCAUACAGG (SEQ ID NO: 769) |
| PL8369 | 232 | 5.619 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG CUCACCAAUACGCGCAAAUUUGAAAAUGUAGU UCGAGGUCCAGGCCUAAGGAAGGAGU (SEQ ID NO: 772) | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA CCAAUACGCGCAAAUUUGAAAAUGUAGUUCGAG G (SEQ ID NO: 773) |
| PL8375 | 232 | 5.505 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG CUCACCAAUACGCGCAAAUUUGAAAAUGUAGU UCGAGGUUGGUGAAGUAGGGCCUCCU (SEQ ID NO: 774) | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA CCAAUACGCGCAAAUUUGAAAAUGUAGUUCGAG G (SEQ ID NO: 773) |
| PL8378 | 232 | 0.994 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG CUCACCAAUACGCGCAAAUUUGAAAAUGUAGU UCGAGGAAUUCCGGGUAUCCCAGGAG (SEQ ID NO: 775) | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA CCAAUACGCGCAAAUUUGAAAAUGUAGUUCGAG G (SEQ ID NO: 773) |
| PL8379 | 232 | 0.767 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG CUCACCAAUACGCGCAAAUUUGAAAAUGUAGU UCGAGGUUCAUUGCAGAAAGAGACAU (SEQ ID NO: 776) | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA CCAAUACGCGCAAAUUUGAAAAUGUAGUUCGAG G (SEQ ID NO: 773) |
| PL8383 | 232 | 0.505 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG CUCACCAAUACGCGCAAAUUUGAAAAUGUAGU UCGAGGAGAUCACGAGGAAUACAACA (SEQ ID NO: 777) | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA CCAAUACGCGCAAAUUUGAAAAUGUAGUUCGAG G (SEQ ID NO: 773) |
| PL8386 | 232 | 3.165 | AACUGCCGGUAAGAUUACGAUAGCCGAAAGGC AAUUGCGUAUGCGGCAGUUAAGGCCGGCUCGA ACGGCCUGAAGGUUGAGUUUAAAGUCACAUAU AAGCGGAAAAAUCAGAUUUCCCAUUGUGUUCG | AACUGCCGGUAAGAUUACGAUAGCCGAAAGGCA AUUGCGUAUGCGGCAGUUAAGGCCGGCUCGAAC GGCCUGAAGGUUGAGUUUAAAGUCACAUAUAAG CGGAAAAAUCAGAUUUCCCAUUGUGUUCGCUCA |

TABLE 34-continued

Results of Indel experiment with D2S effectors

| Comp. | Enzyme SEQ ID NO | Indel Percent | sgRNA sequence with spacer | sgRNA sequence without spacer |
|---|---|---|---|---|
| | | | CUCACCAAUACGCGCAAAUUUGAAAAUGUAGU UCGAGGCAGCCGGGAGGAGCAGCAAG (SEQ ID NO: 778) | CCAAUACGCGCAAAUUUGAAAAUGUAGUUCGAG G (SEQ ID NO: 773) |
| PL8427 | 231 | 0.832 | ACCGAGGCCGCGAAAAACACAACGCUAGCCGA AAGGCAAUCGCGGGUGCGCGGCCGAAGGCCGA CUAGAGCGGCCUGAAGGUUGAGAAGCGUGCAU GUAAACGGCAGAAAAAAUGCCUUUUGUACGCG CUCACCGAACACGUCUGAGCGGUUUGAAAGGU GUGCUCUAGGACUAUGGGAUCAAGCCGCUG (SEQ ID NO: 779) | ACCGAGGCCGCGAAAAACACAACGCUAGCCGAAA GGCAAUCGCGGGUGCGCGGCCGAAGGCCGACUA GAGCGGCCUGAAGGUUGAGAAGCGUGCAUGUAA ACGGCAGAAAAAAUGCCUUUUGUACGCGCUCAC CGAACACGUCUGAGCGGUUUGAAAGGUGUGCUC UAGG (SEQ ID NO: 780) |
| PL5995 | 228 | 23.175 | GGGGUUGUUGGAAACCCUUAUGCUGAGGGAUU AUUCCACUCGGUAAGUACCUUAAAUAGUUAUA GAAAGAUGUAAAUCAUCUAUAAAAGAAAGGUA CAUCCAACGCCUGGAGGCUAUCCAGCGU (SEQ ID NO: 781) | GGGGUUGUUGGAAACCCUUAUGCUGAGGGAUUA UUCCACUCGGUAAGUACCUUAAAUAGUUAUAGA AAGAUGUAAAUCAUCUAUAAAAGAAAGGUACAU CCAAC (SEQ ID NO: 782) |
| PL6002 | 228 | 0.564 | GGGGUUGUUGGAAACCCUUAUGCUGAGGGAUU AUUCCACUCGGUAAGUACCUUAAAUAGUUAUA GAAAGAUGUAAAUCAUCUAUAAAAGAAAGGUA CAUCCAACACUUUCCAUUCUCUGCUGGA (SEQ ID NO: 783) | GGGGUUGUUGGAAACCCUUAUGCUGAGGGAUUA UUCCACUCGGUAAGUACCUUAAAUAGUUAUAGA AAGAUGUAAAUCAUCUAUAAAAGAAAGGUACAU CCAAC (SEQ ID NO: 782) |
| PL8069 | 213 | 2.442 | AAGAUAUGAAUAGGAGUAUUCCUAUGGGGCAG UUGGUUGCCCUUAGCCUGAGGUAUUUAAUGCA CUCGGGAAGUACUUUCAACAGUAUCCGUUAGA AAAGGUACAUCCAACGUGUUGCUGGAGGGGGC CUU (SEQ ID NO: 784) | AAGAUAUGAAUAGGAGUAUUCCUAUGGGGCAGU UGGUUGCCCUUAGCCUGAGGUAUUUAAUGCACU CGGGAAGUACUUUCAACAGUAUCCGUUAGAAAA GGUACAUCCAAC (SEQ ID NO: 785) |

TABLE 35

D2S effectors and targets PAM sequences

| Enzyme SEQ ID NO | PAM sequence(s) |
|---|---|
| 220 | TCG (SEQ ID NO: 156) |
| 233 | TTR (SEQ ID NO: 786); TR (SEQ ID NO: 787) |
| 240 | TTR (SEQ ID NO: 786); TTTR (SEQ ID NO: 788) |
| 16 | CC (SEQ ID NO: 155) |
| 14 | CC (SEQ ID NO: 155) |
| 15 | CC (SEQ ID NO: 155) |
| 239 | CC (SEQ ID NO: 155) |
| 232 | TTTYC (SEQ ID NO: 789) |
| 231 | CCN (SEQ ID NO: 790) |
| 228 | TG (SEQ ID NO: 791); TNTG (SEQ ID NO: 368) |
| 213 | GGTYG (SEQ ID NO: 792) |

Example 23: Effector Protein Tags

CasM.19952 (SEQ ID NO: 23) was purified with a TEV-cleavable MBP tag, which has the TEV cleavage site of ENLYFQSNA (SEQ ID NO: 811). Proteins purified with a TEV-cleavable MBP tag may be useful for various applications, including but not limited to modifying a cell ex vivo. TEV cleavage typically happens before it is introduced in the cell. After TEV cleavage, the protein's N terminus retains the three additional amino acids (SerAsnAla; SNA). This is true regardless of whether NLSs are also present.

Similarly, effector proteins with different tags including T2A, His, FLAG and GFP, were developed for various purposes. Exemplary sequences are described in Tables 36 and 37. In particular, examples of the tagged constructs are shown in Table 36 and individual components of tagged constructs are shown in Table 37. The components of the tagged constructs shown in Table 37 can be applied to any D2S effector protein disclosed herein for example to SEQ ID NOs: 1-45, 202-293, or 728-731.

TABLE 36

Tagged Construct Examples

| Description | SEQ ID NO: | Amino Acid Sequence |
|---|---|---|
| Full Uncleaved TEV-Cleavable and MBP tag sequence of | 812 | MKSSinnnnniHHiniGSSMKIEEGKLVIWINGDKGYNGLAEVGKKFEKDTGIKVTVEH PDKLEEKFPQVAATGDGPDIIFWAHDRFGGYAQSGLLAEITPDKAFQDKLYPFTWDAV RYNGKLIAYPIAVEALSLIYNKDLLPNPPKTWEEIPALDKELKAKGKSALMFNLQEPYFT |

TABLE 36-continued

Tagged Construct Examples

| Description | SEQ ID NO: | Amino Acid Sequence |
|---|---|---|
| CasM.19952 | | WPLIAADGGYAFKYENGKYDIKDVGVDNAGAKAGLTFLVDLIKNKHMNADTDYSIAE<br>AAFNKGETAMTINGPWAWSNIDTSKVNYGVTVLPTFKGQPSKPFVGVLSAGINAASPN<br>KELAKEFLENYLLTDEGLEAVNKDKPLGAVALKSYEEELAKDPRIAATMENAQKGEIM<br>PNIPQMSAFWYAVRTAVINAASGRQTVDEALKDAQTNSSSNNNNNNNNNLGIEENLY<br>FQSNAMPTITRKIELTLLTEGLSEEQRKEQWGLLYHINDNLYKAANNISSKLYLDDHVS<br>SMVRMKHAEYLSLLKELARAEKQKTPDADAIAELRKKVAAAEKEMTDQEHAICKYAT<br>EMSTQSLSYRFATELETNIFAKILDCLKQGVFATFNSDARDVKRGERAIRNYKKGMPIPF<br>AWDKSLRIEKDNKDFYLRWYNGLRFLFNFGKDRSNNRLIVERCLKMDADYDGEYKLC<br>NSSIQIAKREGKTKLFLLLVVKIPQEHVELNKKVVVGVDLGINVPAYVATNITEERKAIG<br>DREHFLNSRMAFQRRYKSLQRLRGTAGGKGRAKKLEPLERLRKAEHNWVHTQNHLFS<br>REVVDFAVKSHAATIHMEDLSGFGKDNDGNADERKEFVLRNWSYYELQNMIAYKAA<br>KYGIKVEKIHPAYTSKTCSWCGQLGFREGVTF1CENPECKQCGEKVHADYNAARNLAN<br>SKDIIKKNE |
| Full cleaved TEV-Cleavable and MBP tag sequence of CasM.19952 | 813 | SNAMPTITRKIELTLLTEGLSEEQRKEQWGLLYHINDNLYKAANNISSKLYLDDHVSSM<br>VRMKHAEYLSLLKELARAEKQKTPDADAIAELRKKVAAAEKEMTDQEHAICKYATEM<br>STQSLSYRFATELETNIFAKILDCLKQGVFATFNSDARDVKRGERAIRNYKKGMPIPFA<br>WDKSLRIEKDNKDFYLRWYNGLRFLFNFGKDRSNNRLIVERCLKMDADYDGEYKLCN<br>SSIQIAKREGKTKLFLLLVVKIPQEHVELNKKVVVGVDLGINVPAYVATNITEERKAIGD<br>REHFLNSRMAFQRRYKSLQRLRGTAGGKGRAKKLEPLERLRKAEHNWVHTQNHLFSR<br>EVVDFAVKSHAATIHMEDLSGFGKDNDGNADERKEFVLRNWSYYELQNMIAYKAAK<br>YGIKVEKIHPAYTSKTCSWCGQLGFREGVTFICENPECKQCGEKVHADYNAARNIANS<br>KDIIKKNE |
| Full sequence of His and GFP tagged CasM.19952 | 814 | MKSSHHHHHHGSSMPTITRKIELTLLTEGLSEEQRKEQWGLLYHINDNLYKAANNISS<br>KLYLDDHVSSMVRMKHAEYLSLLKELARAEKQKTPDADAIAELRKKVAAAEKEMTD<br>QEHAICKYATEMSTQSLSYRFATELETNIFAKILDCLKQGVFATFNSDARDVKRGERAIR<br>NYKKGMPIPFAWDKSLRIEKDNKDFYLRWYNGLRFLFNFGKDRSNNRLIVERCLKMD<br>ADYDGEYKLCNSSIQIAKREGKTKLFLLLVVKIPQEHVELNKKVVVGVDLGINVPAYV<br>ATNITEERKAIGDREHFLNSRMAFQRRYKSLQRLRGTAGGKGRAKKLEPLERLRKAEH<br>NWVHTQNHLFSREVVDFAVKSHAATIHMEDLSGFGKDNDGNADERKEFVLRNWSYY<br>ELQNMIAYKAAKYGIKVEKIHPAYTSKTCSWCGQLGFREGVTFICENPECKQCGEKVH<br>ADYNAARNIANSKDIIKKNEGSDGGSGGGSTSRDHMVLHEYVNAAGIT |
| Full uncleaved sequence of T2A tagged CasM.19952 | 815 | MDYKDHDGDYKDHDIDYKDDDDKMAPKKKRKVGIHGVPAAMPTITRKIELTLLTEGL<br>SEEQRKEQWGLLYHINDNLYKAANNISSKLYLDDHVSSMVRMKHAEYLSLLKELARA<br>EKQKTPDADAIAELRKKVAAAEKEMTDQEHAICKYATEMSTQSLSYRFATELETNIFA<br>KILDCLKQGVFATFNSDARDVKRGERAIRNYKKGMPIPFAWDKSLRIEKDNKDFYLRW<br>YNGLRFLFNFGKDRSNNRLIVERCLKMDADYDGEYKLCNSSIQIAKREGKTKLFLLLVV<br>KIPQEHVELNKKVVVGVDLGINVPAYVATNITEERKAIGDREHFLNSRMAFQRRYKSL<br>QRLRGTAGGKGRAKKLEPLERLRKAEHNWVHTQNHLFSREVVDFAVKSHAATIHMED<br>LSGFGKDNDGNADERKEFVLRNWSYYELQNMIAYKAAKYGIKVEKIHPAYTSKTCSW<br>CGQLGFREGVTFICENPECKQCGEKVHADYNAARNIANSKDIIKKNEKRPAATKKAGQ<br>AKKKKEFGSGEGRGSLLTCGDVEENPGP |
| Cleaved sequence of T2A tagged CasM.19952 | 816 | MDYKDHDGDYKDHDIDYKDDDDKMAPKKKRKVGIHGVPAAMPTITRKIELTLLTEGL<br>SEEQRKEQWGLLYHINDNLYKAANNISSKLYLDDHVSSMVRMKHAEYLSLLKELARA<br>EKQKTPDADAIAELRKKVAAAEKEMTDQEHAICKYATEMSTQSLSYRFATELETNIFA<br>KILDCLKQGVFATFNSDARDVKRGERAIRNYKKGMPIPFAWDKSLRIEKDNKDFYLRW<br>YNGLRFLFNFGKDRSNNRLIVERCLKMDADYDGEYKLCNSSIQIAKREGKTKLFLLLVV<br>KIPQEHVELNKKVVVGVDLGINVPAYVATNITEERKAIGDREHFLNSRMAFQRRYKSL<br>QRLRGTAGGKGRAKKLEPLERLRKAEHNWVHTQNHLFSREVVDFAVKSHAATIHMED<br>LSGFGKDNDGNADERKEFVLRNWSYYELQNMIAYKAAKYGIKVEKIHPAYTSKTCSW<br>CGQLGFREGVTFICENPECKQCGEKVHADYNAARNIANSKDIIKKNEKRPAATKKAGQ<br>AKKKKEFGSGEGRGSLLTCGDVEENPG |

TABLE 37

Components of Tagged Constructs

| Description | SEQ ID NO: | Amino Acid Sequence |
|---|---|---|
| N-terminus sequence of TEV-cleavable | 817 | MKSSHHHHHHHHHHGSSMKIEEGKLVIWINGDKGYNGLAEVGKKFEKDTGIKVTVEH<br>PDKLEEKFPQVAATGDGPDIIFWAHDRFGGYAQSGLLAEITPDKAFQDKLYPFTWDAV<br>RYNGKLIAYPIAVEALSLIYNKDLLPNPPKTWEEIPALDKELKAKGKSALMFNLQEPYFT |
| MBP tag before CasM.19952 | | WPLIAADGGYAFKYENGKYDIKDVGVDNAGAKAGLTFLVDLIKNKHMNADTDYSIAE<br>AAFNKGETAMTINGPWAWSNIDTSKVNYGVTVLPTFKGQPSKPFVGVLSAGINAASPN<br>KELAKEFLENYLLTDEGLEAVNKDKPLGAVALKSYEEELAKDPRIAATMENAQKGEIM<br>PNIPQMSAFWYAVRTAVINAASGRQTVDEALKDAQTNSSSNNNNNNNNNLGIEENLY<br>FQSNA |

TABLE 37-continued

Components of Tagged Constructs

| Description | SEQ ID NO: | Amino Acid Sequence |
|---|---|---|
| 10X His tag | 818 | HHHHHHHHHH |
| MBP tag | 819 | MKIEEGKLVIWINGDKGYNGLAEVGKKFEKDTGIKVTVEHPDKLEEKFPQVAATGDGP DIIFWAHDRFGGYAQSGLLAEITPDKAFQDKLYPFTWDAVRYNGKLIAYPIAVEALSLI YNKDLLPNPPKTWEEIPALDKELKAKGKSALMFNLQEPYFTWPLIAADGGYAFKYENG KYDIKDVGVDNAGAKAGLTFLVDLIKNKHMNADTDYSIAEAAFNKGETAMTINGPWA WSNIDTSKVNYGVTVLPTFKGQPSKPFVGVLSAGINAASPNKELAKEFLENYLLTDEGL EAVNKDKPLGAVALKSYEEELAKDPRIAATMENAQKGEIMPNIPQMSAFWYAVRTAVI NAASGRQTVDEALKDAQT |
| N-terminus His6 tag plus linker before CasM.19952 | 820 | MKSSHHHHHHGSS |
| C-terminus Linker-GFP11 tag after CasM.19952 | 821 | GSDGGSGGGSTSRDHMVLHEYVNAAGIT |
| N terminus of T2A tagged effector protein | 822 | MDYKDHDGDYKDHDIDYKDDDDKMAPKKKRKVGIHGVPAA |
| 3x FLAG tag of N terminus of T2A tagged effector protein | 823 | MDYKDHDGDYKDHDIDYKDDDDK |
| SV40 NLS sequence ofN terminus of T2A tagged effector protein | 712 | PKKKRKV |
| C terminus of T2A tagged effector protein | 824 | KRPAATKKAGQAKKKKEFGSGEGRGSLLTCGDVEENPGP |
| NLS (nucleoplasmin) of C terminus of T2A tagged effector protein | 825 | KRPAATKKAGQAKKKK |
| T2A self-cleaving peptide sequence | 826 | GSGEGRGSLLTCGDVEENPGP |

Example 24: CasM.19952 Demonstrates Blunt Cutting of dsDNA

Figure 12:
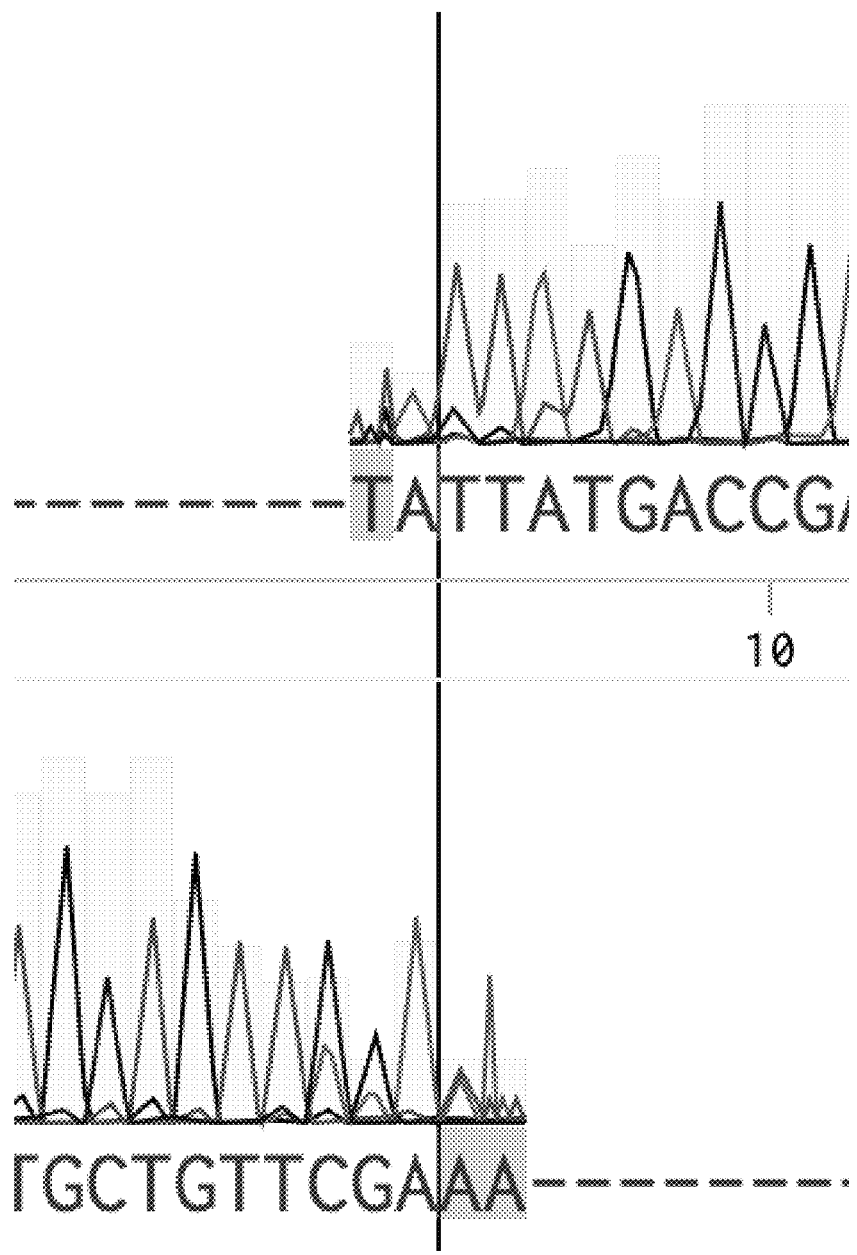
FIG. 12 shows Sanger sequencing reads of target and non target strands from CasM.19952 sgRNA complex and a target nucleic acid having a PAM of GTCG; top read SEQ ID NO: 956 and bottom read SEQ ID NO: 957 are depicted.

A CasM.19952 (SEQ ID NO: 23) sgRNA complex (200 nM) was incubated with a target nucleic acid having a PAM of GTCG (10 nM) at 37 degrees Celsius for 1 hour in CutSmart buffer. Purified and amplified fragments were subjected to Sanger sequencing using multiple forward and reverse primers to read both the target and non target strands. FIG. 12 shows the sequencing reads which were interpreted as blunt cutting.

Example 25: D2S Sequence Similarity

The following method was used to calculate the similarity of D2S enzymes disclosed herein to CasM.19952, as well as the similarity of sequences within each D2S enzyme sequence to the multilevel consensus sequence/PROSITE motifs described in Example 21.

The BLOSUM62 similarity matrix (Henikoff & Henikoff, 1992) was transformed so that any value ≥1 was replaced with +1 and any value ≤0 was replaced with 0. For example, the Ile to Leu substitution is scored at +2.0; in the transformed matrix, it is scored at +1. This transformation allows the calculation of percent similarity, rather than a similarity score.

For similarity over the MEME motifs, the multilevel consensus sequence (or PROSITE motif sequence) was used to identify how strongly each motif was conserved. In calculating the similarity of a motif sequence, the second and third levels of the multilevel sequence were treated as equivalent to the top level. Alternately, when comparing two full protein sequences, the proteins were aligned using pairwise MUSCLE alignment. Then, the similarity was scored at each residue and divided by the length of the alignment.

If a substitution could be treated as conservative with any of the amino acids in that position of the multilevel consensus sequence, +1 point was assigned. For example, given the multilevel consensus sequence:
RLG
YCK
. . . the test sequence QIQ would receive three points. This is because in the transformed BLOSUM62 matrix, each combination is scored as: Q-R: +1; Q-Y: +0; I-L: +1; I-C: +0; Q-G: +0; Q-K: +1 For each position, the highest score is used when calculating similarity.

The score over the length of the motif was divided by the length of the motif to provide the % similarity. In the example above, the % similarity would be 100%. This process is equivalent to the percent similarity calculation used by the Geneious Prime software given the parameters matrix=BLOSUM62 and threshold ≥1.

As shown in Table 41, there are 24 D2S enzymes with greater than 70% similarity to CasM.19952. Including CasM.19952, there are 26 sequences that have greater than 80% similarity to six or more of the MEME motifs, as shown in Table 42. Of these, 19 (excluding CasM.19952 itself) have greater than 80% similarity to the MEME motifs of CasM.19952. These are the same 19 sequences with at least 75% identity to CasM.19952 overall.

TABLE 41

| D2S Effector Protein Sequence Similarity | |
|---|---|
| Effector Protein Name | % similarity to CasM.19952 |
| CasM.19952 | 100.0 |
| CasM.288480 | 97.9 |
| CasM.274559 | 96.8 |
| CasM.272451 | 95.9 |
| CasM.289206 | 92.3 |
| CasM.289248 | 92.3 |
| CasM.290598 | 92.9 |
| CasM.287826 | 92.1 |
| CasM.294406 | 89.8 |
| CasM.286251 | 90.2 |
| CasM.290816 | 90.4 |
| CasM.287936 | 90.0 |
| CasM.270012 | 91.2 |

TABLE 41-continued

| D2S Effector Protein Sequence Similarity | |
|---|---|
| Effector Protein Name | % similarity to CasM.19952 |
| CasM.295231 | 90.9 |
| CasM.19498 | 87.4 |
| CasM.288450 | 90.8 |
| CasM.19948 | 88.5 |
| CasM.279423 | 89.5 |
| CasM.295071 | 86.4 |
| CasM.288668 | 86.1 |
| CasM.285333 | 78.0 |
| CasM.290380 | 76.3 |
| CasM.287128 | 76.0 |
| CasM.286678 | 75.7 |
| CasM.19924 | 71.6 |
| CasM.292139 | 65.1 |
| CasM.265291 | 58.9 |
| CasM.296640 | 60.4 |
| CasM.288712 | 59.0 |
| CasM.294190 | 57.5 |
| CasM.299584 | 57.0 |
| CasM.298446 | 50.6 |

TABLE 42

D2S MEME motif percent similarity

| Effector Protein | MEME_1 | MEME_2 | MEME_3 | MEME_4 | MEME_5 | MEME_6 | MEME_7 |
|---|---|---|---|---|---|---|---|
| CasM.19952 | 96.0 | 96.6 | 100.0 | 100.0 | 95.2 | 80.0 | 87.0 |
| CasM.288480 | 96.0 | 96.6 | 100.0 | 100.0 | 95.2 | 80.0 | 87.0 |
| CasM.274559 | 94.0 | 93.1 | 95.2 | 100.0 | 95.2 | 80.0 | 87.0 |
| CasM.272451 | 94.0 | 93.1 | 100.0 | 100.0 | 100.0 | 80.0 | 87.0 |
| CasM.289206 | 92.0 | 93.1 | 100.0 | 100.0 | 100.0 | 100.0 | 91.3 |
| CasM.289248 | 94.0 | 93.1 | 100.0 | 100.0 | 100.0 | 100.0 | 91.3 |
| CasM.290598 | 96.0 | 93.1 | 100.0 | 100.0 | 100.0 | 76.7 | 82.6 |
| CasM.287826 | 96.0 | 93.1 | 100.0 | 100.0 | 100.0 | 100.0 | 87.0 |
| CasM.294406 | 94.0 | 96.6 | 95.2 | 97.6 | 95.2 | 93.3 | 87.0 |
| CasM.286251 | 94.0 | 93.1 | 95.2 | 97.6 | 100.0 | 100.0 | 87.0 |
| CasM.290816 | 96.0 | 89.7 | 100.0 | 95.1 | 95.2 | 100.0 | 91.3 |
| CasM.287936 | 94.0 | 93.1 | 95.2 | 97.6 | 100.0 | 100.0 | 87.0 |
| CasM.270012 | 92.0 | 93.1 | 100.0 | 100.0 | 100.0 | 100.0 | 87.0 |
| CasM.295231 | 96.0 | 89.7 | 100.0 | 95.1 | 95.2 | 100.0 | 87.0 |
| CasM.19498 | 92.0 | 93.1 | 100.0 | 100.0 | 100.0 | 100.0 | 91.3 |
| CasM.288450 | 92.0 | 89.7 | 100.0 | 95.1 | 95.2 | 86.7 | 91.3 |
| CasM.19948 | 94.0 | 93.1 | 100.0 | 95.1 | 100.0 | 100.0 | 87.0 |
| CasM.279423 | 96.0 | 93.1 | 100.0 | 97.6 | 100.0 | 100.0 | 87.0 |
| CasM.295071 | 94.0 | 93.1 | 95.2 | 97.6 | 100.0 | 100.0 | 87.0 |
| CasM.288668 | 94.0 | 93.1 | 95.2 | 97.6 | 100.0 | 93.3 | 91.3 |
| CasM.285333 | 64.0 | 86.2 | 95.2 | 92.7 | 95.2 | 93.3 | 91.3 |
| CasM.290380 | 80.0 | 89.7 | 100.0 | 92.7 | 90.5 | 86.7 | 95.7 |
| CasM.287128 | 80.0 | 86.2 | 100.0 | 95.1 | 95.2 | 93.3 | 95.7 |
| CasM.286678 | 82.0 | 89.7 | 100.0 | 92.7 | 95.2 | 86.7 | 95.7 |
| CasM.19924 | 100.0 | 86.2 | 90.5 | 68.3 | 90.5 | 86.7 | 91.3 |
| CasM.292139 | 86.0 | 82.8 | 90.5 | 61.0 | 90.5 | 93.3 | 95.7 |
| CasM.265291 | 74.0 | 72.4 | 76.2 | 68.3 | 85.7 | 80.0 | 69.6 |
| CasM.296640 | 76.0 | 75.9 | 85.7 | 53.7 | 85.7 | 80.0 | 73.9 |
| CasM.294190 | 74.0 | 69.0 | 76.2 | 70.7 | 71.4 | 80.0 | 69.6 |
| CasM.288712 | 78.0 | 75.9 | 85.7 | 52.4 | 81.0 | 80.0 | 73.9 |
| CasM.299584 | 84.0 | 69.0 | 85.7 | 58.5 | 95.2 | 80.0 | 69.6 |
| CasM.298446 | 84.0 | 86.2 | 76.2 | | 71.4 | 93.3 | 73.9 |
| CasM.289802 | | 58.6 | 61.9 | 43.9 | 66.7 | | 60.9 |
| CasM.286285 | | 58.6 | | 53.7 | 81.0 | | 69.6 |
| CasM.20054 | 88.0 | 82.8 | 90.5 | | 76.2 | 93.3 | 78.3 |
| CasM.284933 | 80.0 | 89.7 | 85.7 | | 76.2 | 93.3 | 73.9 |
| CasM.289726 | | 58.6 | 57.1 | 46.3 | 61.9 | | 65.2 |
| CasM.294537 | 88.0 | 79.3 | 95.2 | | 81.0 | 80.0 | 69.6 |
| CasM.295929 | 86.0 | 82.8 | 90.5 | | 76.2 | 93.3 | 78.3 |
| CasM.298538 | 82.0 | 75.9 | 95.2 | 41.5 | 81.0 | 80.0 | 73.9 |
| CasM.286588 | 82.0 | 79.3 | 76.2 | 36.6 | 76.2 | 86.7 | 65.2 |
| CasM.19910 | 90.0 | 75.9 | 95.2 | | 81.0 | 86.7 | 69.6 |
| CasM.291449 | 84.0 | 75.9 | 90.5 | | 81.0 | 86.7 | 73.9 |
| CasM.293576 | 86.0 | 75.9 | 95.2 | | 85.7 | 80.0 | 65.2 |
| CasM.287896 | 84.0 | 82.8 | 90.5 | | 81.0 | 70.0 | 69.6 |

TABLE 42-continued

D2S MEME motif percent similarity

| Effector Protein | MEME_1 | MEME_2 | MEME_3 | MEME_4 | MEME_5 | MEME_6 | MEME_7 |
|---|---|---|---|---|---|---|---|
| CasM.293410 | 90.0 | 82.8 | 90.5 | 31.7 | 81.0 | 93.3 | 78.3 |
| CasM.295187 | 90.0 | 82.8 | 90.5 | 31.7 | 81.0 | 93.3 | 78.3 |
| CasM.297599 | 86.0 | 79.3 | 95.2 |  | 85.7 | 86.7 | 63.0 |
| CasM.286910 | 88.0 | 79.3 | 95.2 |  | 81.0 | 80.0 | 69.6 |
| CasM.296642 | 92.0 | 79.3 | 95.2 |  | 71.4 | 93.3 | 73.9 |
| CasM.298612 | 82.0 | 79.3 | 95.2 |  | 81.0 | 80.0 | 65.2 |
| CasM.274429 | 90.0 | 75.9 | 90.5 | 41.5 | 81.0 | 93.3 | 69.6 |
| CasM.282673 | 88.0 | 82.8 | 90.5 |  | 85.7 | 86.7 | 78.3 |
| CasM.294601 | 72.0 | 72.4 | 76.2 |  |  |  | 60.9 |
| CasM.294270 | 86.0 | 93.1 | 66.7 |  | 76.2 | 100.0 | 65.2 |
| CasM.295105 | 90.0 | 89.7 | 95.2 |  | 81.0 | 93.3 | 73.9 |
| CasM.19548 | 80.0 | 75.9 | 95.2 | 39.0 | 81.0 | 86.7 | 69.6 |
| CasM.287908 | 86.0 | 96.6 | 85.7 |  | 81.0 | 93.3 | 78.3 |
| CasM.291507 | 86.0 | 86.2 | 95.2 |  | 85.7 | 93.3 | 73.9 |
| CasM.283262 | 90.0 | 89.7 | 95.2 |  | 81.0 | 93.3 | 73.9 |
| CasM.295201 | 88.0 | 79.3 | 95.2 |  | 85.7 | 93.3 | 65.2 |
| CasM.284833 | 86.0 | 86.2 | 90.5 |  | 81.0 | 93.3 | 73.9 |
| CasM.294655 | 88.0 | 89.7 | 90.5 |  | 85.7 | 86.7 | 69.6 |
| CasM.277328 | 82.0 | 93.1 | 90.5 |  | 85.7 | 93.3 | 73.9 |
| CasM.292335 | 84.0 | 82.8 | 85.7 | 41.5 | 85.7 | 80.0 | 69.6 |
| CasM.294491 | 86.0 | 93.1 | 85.7 |  | 81.0 | 86.7 | 78.3 |
| CasM.293203 | 88.0 | 75.9 | 90.5 |  | 90.5 | 86.7 | 73.9 |
| CasM.287700 | 88.0 | 89.7 | 95.2 |  | 81.0 | 100.0 | 73.9 |
| CasM.280852 | 66.0 | 72.4 | 76.2 |  |  | 93.3 | 60.9 |
| CasM.293891 | 80.0 | 96.6 | 85.7 |  | 81.0 | 93.3 | 69.6 |
| CasM.281060 | 84.0 | 93.1 | 66.7 |  | 76.2 | 100.0 | 73.9 |
| CasM.299588 | 86.0 | 82.8 | 90.5 |  | 76.2 | 100.0 | 69.6 |
| CasM.288518 | 82.0 | 93.1 | 90.5 |  | 76.2 | 70.0 | 73.9 |
| CasM.280604 | 84.0 | 89.7 | 90.5 |  | 85.7 |  | 78.3 |
| CasM.298706 | 88.0 | 89.7 | 76.2 |  | 71.4 | 93.3 | 73.9 |
| CasM.281050 | 88.0 | 75.9 | 95.2 |  | 76.2 | 93.3 | 69.6 |
| CasM.277378 | 86.0 | 86.2 | 90.5 |  | 81.0 | 93.3 | 73.9 |
| CasM.297894 | 88.0 | 89.7 | 76.2 |  | 71.4 | 93.3 | 73.9 |
| CasM.295047 | 80.0 | 89.7 | 85.7 |  | 76.2 | 93.3 | 73.9 |
| CasM.282952 | 88.0 | 89.7 | 85.7 |  | 85.7 | 80.0 | 78.3 |
| CasM.298142 | 66.0 | 69.0 | 81.0 |  |  |  | 60.9 |
| CasM.292901 | 72.0 | 72.4 | 59.5 |  |  |  | 60.9 |
| CasM.298264 |  |  | 52.4 |  | 38.1 |  |  |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (958 sequences)

SEQ ID NO: 1 - protein, 455 aa, Artificial Sequence
  Description of Artificial Sequence: Synthetic polypeptide
  CasM.298706
MAKKGTNRKKMIVKVMKYELKYESGCADFNEMQNELWKLQRQTREVMNRTIQLCYHWSYVQADYCKQHGCARRDVKPCDVYETNATSLDGYIYQLFKDEYPNFLMANLIATLRKAHQKYDALLFDIQEGNSSIPSFKKDQPLIFSKEAIRLPECLSDKRQITLFCFSKPYKSAHPTLDKITFAVRARSASEKSIFDHIISGKYALGESQLVYEKKKWFFLLSYKFTPESVDVNPEKVLGVDLGVVNALCAGSVENPHDSLFIKGTEAIEQIRRLEARKRDLQKQARYPGDGRIGHGTKTRVSPVYQTRDAIARMQDTLNHRWSRALIDFACKKGYGTIQMEDLSGIKALESEKPYLKHWTYFDLQSKIIYKAEEKGIRVVKVNPKCTSRRCSACGYISKENRKNQVEFLCVNCGYHHNADYNAAQNLSIPQIDRLIEKQLKEQESEENEAGANPK

SEQ ID NO: 2 - protein, 410 aa, Artificial Sequence
  Description of Artificial Sequence: Synthetic polypeptide
  CasM.280604
MAKGTLSKVMKYELRYLDGCGDFQNMQKELWTLQRQSREILNRTIQIAYHWDYTDREQFKKTGQHLDIKAETGYKRLDGYIYDSLKEDVQNFASVNVNATIQKAWAKYKSSKIDVLRGDMSLPSYKSDQPLVLHAQSMKIFSSDDDDVLQVTLFSNAYKKACNYSNIRFIIGLHDATQRTIIKKVLSGDWGIGQSQIVYKRPKWFLYLTYNFSPEQHEVNPDKILGVDLGESIAIYASSIGEYGSLRIEGGEISAFAKQLEARKRSLQKQAAYCGKGRIGHGTKSRVSDVYKMEDKIANFRNTVNHRYSKMLIDYALKHMYGTIQMEDLSGIKKETGFPKFLQHWTYYDLQQKIEAKAKEHGINFIKVDPAFTSQRCSKCGNIDSENRPSQAVFCCKKCGYKTNADFNAS

SEQ ID NO: 3 - protein, 426 aa, Artificial Sequence
  Description of Artificial Sequence: Synthetic polypeptide
  CasM.281060
MNVTKVMRYQLIYQGGGGDFESLQNQLWEFQRQTRAILNKTIQTMYLATANQEKFSEKALYHDLCAEYPDMISSTVNATLREATKKYRSSVREILAGRMSLPSYKRDHPILLHNQSVALKQGNQGSYFATISVFSRKYQQGTPGVKQPSFQLIAKDNTQRTILQRLLSGEYKLGQCQLIYIRPKWFLNVAYSFTPSEKALDQEKVLGVDLGCVYAIYASSYGNHGIFKISGDEITSFERKQAAIQNRAFKNDLTRIREIEERRKQKLEQARYCGEGRIGHGVKTRVAPAYQDEGKISRFRETINHRYSKALVDYAEKNGYGTIQMEDLSGIKSSTGFPKRLQHWTYFDLQQKIKYKAEEQGIKVVKIKPAYTSQRCSRCGHIDPANRKSQSEFKCIACGFSSNADYNASQNISMRNIEKIIQGKAN

SEQ ID NO: 4 - protein, 432 aa, Artificial Sequence
  Description of Artificial Sequence: Synthetic polypeptide
  CasM.284933
MAKGTITKVMKYELRYLGGFSDFHEMQKEVWQLQRQYREILNKTIQIALHWDYVSAQQFGESGTYLDIREETGYKTLDGYIYNCLKGAYSEMASANLNAAVQKAWKKYKNSKTQVLQGVMSLPSYKSDQPILIDKGNVKLSAEENNGRAVLTLFSRNYRDTRGLKGNVEFSVLLHDGTQKSIFRNLIDKTYALGQCQLVYERKKWFLLLTYSFTPAGHALDPEKILGVDLGECYALYASSCYAPGILKIEGGEIAEYALRLEKRKRSLQQQARYCGEGRIGHGTKTRVGVVYKAEDRIASFRETINHRYSKELVDYAVSNGYGTIQMEDLSAIQKDLGFPKRLRHWTYYDLQMKITNKAKEHGIAVVKIDPRYTSQRCSKCGHIDPANRPRQEEFCCTACGYACNADYNASQNISIKGIEKIIQKMLSAKAD

SEQ ID NO: 5 - protein, 435 aa, Artificial Sequence
  Description of Artificial Sequence: Synthetic polypeptide
  CasM.287908
MSKGMLTKVMKYTLRYVGGCGDFHEMQSILWELQKQTRAVLNKTIQIAFEWDYRSREAFQETGEYLDVHAETGYKRLDGYIYNCLKNEYADFAGKNLNAAIQTAWKKYNQSKRDIQTGKMSLPSYRSNQPLIIHNDNVMISQDMQAAPSVRFTLLSLEYKKAHDLNTNPTFEVLINDGTQRAIFEKVRSGEYKLGQCMIQYDKKKWFLLLTYSFQPEKLTLDKNKILGVDLGETIVICASSVSERGRFVIDGGEITRFATQIEARKRSQQHQAAYCGEGRIGHGTKTRVDAVYKTEDRIANFRDTINHRYSRALVNYAVKHGFGTIQMEDLSGIKSSDDFPKFLRHWTYYDLQSKIESKAKERGIAVVKVNPRFTSRRCSKCGYIDEGNRKDQAHFCCLSCGFRANADFNASQNLSIKGIDKIIEKEYNANSKQT

SEQ ID NO: 6 - protein, 442 aa, Artificial Sequence
  Description of Artificial Sequence: Synthetic polypeptide
  CasM.288518
MGKPITKTMKYQIHYIDGCGDFHNMQKELWDLQRIVRQILNKTINESYLWFVRSEQYYRDTGENLSVEEQTGYKTLDGHIYNLLKQEYTQKLVSNSLNASIQAAYKKMKDSRRDVMIGTMSLPSYRSDQPIIIYNKNIKFSSHPEHGFVVDCSLFSDAYKKSQGYEKSVKFQVSVDDNTQRSIFENILTGNYKHGQCSIVYEKKKWFLLLTYSFVPEETKLDPDKILGVDVGVVYALYASSKGNHGTFKIKGDEAITFIQRVEARKHSRQLQGTYCGDGRIGHGTKTRVQPVYNERALISNFQDTINHRYSKALIDYAKKNGYGTIQMEDLSGIKEVQQYPKYLQHWTYYDLQLKIQYKAKEAGIGFVKVTPKYTSQRCSHCGNIDEANRPKQDVFRCTVCGYERNADYNASQNLSIKGIDRIIDDQLKQMNKANPKKTENA

SEQ ID NO: 7 - protein, 435 aa, Artificial Sequence
  Description of Artificial Sequence: Synthetic polypeptide
  CasM.293891
MSGGAITKVMKYDLTYKDGYGNFKDMQEAVWKLIRDTRTILNETIKIAYHWDYLNEKSKRETGEHLDLLEETGYKRLDGYIYDDLKDRFPDFASSNLNAAIQTAWKKYKQSQKDVYIGKMTLPSYKSDQPLPINKQSIKIYDEEREHIVELNLFSTKHKKEHGLASNVRFRINLHDNTQHAIYERVLSGEYTLGQCQLLYDRPKWFFILTYSFKPAQNKLDPDKILGVDMGETCALYASTFGEQGSFVINGGEVSEYAKREEARKRSLQKQAAVCGEGRIGHGTKTRVSSVYKEQERISNFRDTINHRYSKALIEYAVKNGCGTIQMEDLSGIRQSTDFPKFLRHWTYYDLQQKIKTKAKETGIAVSMIDPRYTSQRCSRCGHIDKANRKDQAHFHCLKCGYSCNADFNASQNISIRGIDKIIQKELGAKAKQTD

SEQ ID NO: 8 - protein, 431 aa, Artificial Sequence
  Description of Artificial Sequence: Synthetic polypeptide
  CasM.294270
MKEIAKVMKYQLIYLDGGGDFYELQQTLWDLQRQTREILNKTIQSMYLATATNTAFEENALYHRFGAEYPMMAALNVNATLRTAKKRYTSTIKETLRGTMSLPSYKRDQPILLHNQTIHLALEDGQYSALFSVYSEKFQKAHEGVARPRFALMARDGTQRAILDRLLDGSYRLGQSQMTYEQKKWFLSLTYKFVPEVRELDKSKILGVDLGCVYAIYASSMQQKGIFKISGDEITEFEKRQAAMQNREPVSTLERVEQLEQRRWQKQQQARYCGEGRVGHGTGTRVAPAYRDADKIARFRDTINHRYSKALVEYAEKNGFGTIQMEDLSGIKEDTGFPKRLRHWTYFDLQTKIQYKAAERGITVVKIDPQYTSQRCSRCGYIDKANRASQEKFLCQSCGFEANADYNASQNISVEKIDKLIAKDKKKLART

SEQ ID NO: 9 - protein, 436 aa, Artificial Sequence
  Description of Artificial Sequence: Synthetic polypeptide
  CasM.294491
MGQVTKVMRYQLIYQDGGGDFYTVQQELWELQRQTREILNKTIQTMYLADANKEKFDNAAERTLNRRFCVDHPDMYTKTVTATLRKAKAKYNASQKEILAGRMSLPSYKRDQPILLNPQGFKIEEESDSFFAAIAVFSDKYKNKHPDVDVKRLRFRLVVKDGTQRAIIRRVISGEYKLGRSQLLYSKKKWFLNVTYSFEPAEKKVDPDKILGVDLGCVYAIYASSFGSPGVFKISGDEVSSFERKQAAIQNRSPKSTLERVEKIEERHKQKQQQARYCGEGRIGHGTKTRIAPVYQDEDKIARFRDTVNHRYSKALIDYAEKNGYGTIQMEDLSGIKSATGFPKRLKHWTYYDLQTKIEYKAEERGIKVVKIDPRYTSQRCSRCGYIDSGNRKSQAEFCCMACGFSCNADYNASQNISIGGIAKIIADKRKEADAK

SEQ ID NO: 10 - protein, 368 aa, Artificial Sequence
  Description of Artificial Sequence: Synthetic polypeptide
  CasM.295047
YLDIREETGYKTLDGYIYNCLKGAYSEMASANLNAAVQKAWKKYKNSKTQVLQGVMSLPSYKSDQPILIDKGNVKLSAEENNGRAVLTLFSRNYRDTRGLKGNVEFSVLLHDGTQKSIFRNLIDKTYALGQCQLVYERKKWFLLLTYSFTPAGHALDPEKILGVDLGECYALYASSCYAPGILKIEGGEIAEYALRLEKRKRSLQQQARYCGEGRIGHGTKTRVGVVYKAEDRIASFRETINHRYSKELVDYAVSNGYGTIQMEDLSAIQKDLGFPKRLRHWTYYDLQMKITNKAKEHGIAVVKIDPRYTSQRCSKCGHIDPANRPRQEEFCCTACGYACNADYNASQNISIKGIEKIIQKMLSAKAD

SEQ ID NO: 11 - protein, 437 aa, Artificial Sequence
  Description of Artificial Sequence: Synthetic polypeptide
  CasM.299588
MAEKTIVKVMKFELRYIDGAGEFSEMQKHLWELQKQTREVLNKTIQMGYALECKRFAHHDKTGQWLDDKELTGSKYKAVADYINAELKEDYNIFYSDCRNSTVRKAYKKFKDAKNKIFSGEMSLPSYRSNQPIIIHNRNVIIRGNAESALVGLKVFSDGFKALHGFPAAVNFKLCVKDGTQRAIIENVISEIYKISESQLIYDNKKWFLILAYRFTQKKNDLNPDKILGVDLGVKFAVYASSIGEYGSFRIKGGEVTEFIKRLEKRKKSLQNQATVCGDGRIGHGTKTRVADVYKARDKISNFQDTINHRYSRAIVDYARKNGYGTIQLEKLDNSIEKKGDYSPVLVHWTYYDLRTKMEYKAAEYGIKVIAVEPKYTSQRCSKCGYISSENRKTQESFECIKCGYKCNADFNASQNLSVRDIDRIIDEYLGANPELT

SEQ ID NO: 12 - protein, 434 aa, Artificial Sequence
  Description of Artificial Sequence: Synthetic polypeptide
  CasM.277328
VVNVAKGALSKVMKFELSYLDGCGDFQNMQKELWTLQRQTREILNRTIQIAYHWDYTDREHFKKTGQHLDVKSETGYKRLDGYIYDELKETVQNFASVNVNATIQKAWAKYKSSKTDVLRGDMSLPSYKSDQPLVLHAQSIKLSEDKDGPVLQVTLFSNAHKKACDYSNVRFAFRLHDATQRAIFKNVLSGEYGLGQSQIVYKRPKWFLYLTYNFSPEQHGLDPDKILGVDLGESIALYASSLGDYGSLRIEGGEVTAFAKQLEARKRSLQKQAAHCGEGRVGHGTRARVSDVYKAEDKIANFRNTVNHRYSKKLIEYAIQNRYGTIQMEDLSGIKQDTGFPKFLQHWTYYDLQQKIEAKAKENGINFIKVDPSYTSQRCSKCGNIDSDNRPSQAVFCCTKCGFRANADFNASQNLSIPEIDKIIKKERGANTK

SEQ ID NO: 13 - protein, 455 aa, Artificial Sequence
  Description of Artificial Sequence: Synthetic polypeptide
  CasM.297894
MAKKGTNRKKMIVKVMKYELKYEKGCADFNEMQNELWKLQRQTREVMNRTVQLCYHWNYVQADYCKQHGCAHRDVKPCDVYETNATSLDGYIYQLFKDEYPNFLMANLIATLRKAHQKYDALLPDIQEGNSSIPSFKKDQPLIFSKEAIHLPECLSDKRQITLFCFSKPYKSAHPTLDKITFAVRAHSASEKSIFDNIINGKYALGTSQLVYEKKKWFFLLSYKFTPESVDVNPEKVLGVDLGVVNALCAGSVENPHDSLFIKGTEAIEQIRRLEARKRDLQKQARYPGDGRIGHGTKTRVSPVYQTRDAIARMQDTLNHRWSRALIDFACKKGYGTIQMEDLSGIKAMESEKPYLKHWTYFDLQSKIIYKAEEKGIRVVKVNPKCTSRRCSACGYISKENRKNQAEFLCVNCGYHHNADYNAAQNLSIPQIDRLIEKQLKEQESEESEAGANPK

SEQ ID NO: 14 - protein, 500 aa, Artificial Sequence
  Description of Artificial Sequence: Synthetic polypeptide
  CasM.291449
MTERHDNESSKIKAEVSLLNSSVPDFEKKRHVKVLKLHILKPAGDMKWDELGALLRDARYRVFRLANLAISEAYLDFHKWRSGGNEQPKLKISQLNRNLRSMLEDEVTGKQTKMIKSDRYSKSGALPDSIVSPLSMYKLGGLTSKSKWSEVLRGKSSLPTFKLNMAIPVRCDKPGDRRIERTKNGDAEVELRICLQPYPRVIIATGRNSLGDGQRAILDRLLDNTKYSEQGYRQRCFEIKEDQRSGKWHLFVTYDFPAIEPAKNLSRERIVGVDLGAACPLYAAINTGHARLGWKHFSPLAARVRALQNQTIRRRRQILRGGKVSLSEDSARSGHGRKRKLKPISKLEGKIDRAYTTLNHQLSATVIKFAKDNGAGVVQMEDLKGLRETLTGTFLGERWRYEELQRFIRYKADEAGIEIRLVNPQYTSRRCSECGHIHKDFTREFRDKSREGNKSVRFLCPDCGFTADPDYNAARNLASLDIAAIIERQLEIQGLRKHDP

SEQ ID NO: 15 - protein, 471 aa, Artificial Sequence
  Description of Artificial Sequence: Synthetic polypeptide
  CasM.297599
MKEKSKTLVKVARLRILKPAGDMKWSELGEMLRTVRYRVFRLANLAVSEAYLGFHMYRTNRATEFKAETIGKLSRRLREMLIEEGVDEKDLSRYSQTGAVPDTVAGALGQYKIRGITSPTKWRQVVRGQAALPTFRNDMAIPIRCDKQYQRRLEKTEAGEIEVELMICRKPYPRIVLGTADLGPGQRAILERLLQNTDNSADGYRQRLFEAKQDTQTKKWWLYVTYDFPRLKEGKLNQEIVVGVDLGFSIPLYVALNIGHARLGRRHFQALGNRIRSLQRQVLARRRSIQRGGRVNISHSTARSGHGRKRKLLPTEKLRGRIEKSYSTLNHQLSASVIDFAKNHHAGTIQIEDLANLKEELAGTFIGARWRYHQLQQFLKYKAEEAGITLNQVNPRYTSRRCSECGFINIDFDRAFRDAGRTEGRVTKFLCPECGYEADPDYNAARNISILDIDKLIRVQCKKQGLTYDAH

SEQ ID NO: 16 - protein, 475 aa, Artificial Sequence
  Description of Artificial Sequence: Synthetic polypeptide
  CasM.286588
MPERPKTVNKVIWFQIHKPAGDMTWKELGNLLREARYRVFRLANLAVSEKYLSFHMWRTGQEYKSETIGKLNRRLREMLIEEGVEEESQKRFSATGALPDTVVSTLAKGKLAAITSKSKWKDVVNGKTSLPTFKLNMAIPVRCDKAEQRRLRRTESGDVELELMICKQPYPRVVLKTGKLKSGQRAILDRLVENNDNSKEGYSQRVFEIKQVENNDGSKEWRLYISYTFPKKAVEANADVAVGVDIGFSVPLVAAVNNGLERLGYNDFRALNERIRSLQRQVLVRRRSMQSGGRDYVSTPTARSGHGRKRKLLPIQTLRKRWDNAYTTLNHQLSHAVVSFAENHGAATIQIENVKSLKDELRGTFLGQRWRYFELQQFLKYKADEVGIELREVNARYTSRRCSECGYINMAFTRQARDKGRVDGKPMEFVCPECGYKAHPDYNAARNIAMLDIEQKMQVQCKQQGITYADDSEVL

SEQ ID NO: 17 - protein, 448 aa, Artificial Sequence
  Description of Artificial Sequence: Synthetic polypeptide
  CasM.286910
MTWPELGNMLRTVRYRVFRLANLAVSEAYLGFHMFRTKRAEEFKAETMGKLSRRLREMLIEEGVDEKDLSRYSQTGAVPDTVAGALSQYKIRGITSPTKWRQIVRGQVALPTFRNTMSIPVRCDKLYQRRLEQGDSGEVEVELMICRNPYPRVVLGTGDLNPGQQAILERLLQNTDNSADGYRQRLFEIKEDVQTRKWWLYVTYDFPKTTGKLNPEIVVGVDLGFSIPLYVALNSGHARLGYLHFKALGERIKSLQKQVMARRRAIQRGGRVSISHSTARTGHGVKRKLQPTEKLRGRIEKSYSTLNHQLSASVIDFAKNHHAGVIQIEDLSGLKEQLTGTFIGARWRYHQLQQFLKYKAEEAGITLKQINPRYTSRRCSECGFINMDFDRAFRDAGRTYGKVTKFLCPECGYEADPDYNAARNIATLDIEKLIRVQCEKHGLKFDAH

SEQ ID NO: 18 - protein, 477 aa, Artificial Sequence
  Description of Artificial Sequence: Synthetic polypeptide
  CasM.292335
VGKEGKRNVKVMKIRILKPCDGMTWNELGQLLRDARYRVFRLANLTVSEAYLNFHLWRTGRSQEFKKQTIGQLNRQLRNILQQEKYDDEKLNRYSKTGALPDTVCSALWQYKLMAVMKKSKWSEVIRGKSSLPTFRNDMAIPVRCDKPEQKRIEKTEQGQVEAALQVCVQPYPRVILGTHTLGDGQDAILKRLLDNQNQAIGGYRQRSFEIKYDEQKRWWLFITYDFPATEVATDKTIAVGVDLGVSVPLYAAVNNGPARLGRREFGGLGRRIRDLRNQTDARRRSIQRSGREGQSDDTARAGHGRKRKLLPIHILEGRLDKAYTTLNHQMSAAVIKFAAEQGAGIIQIENLAGLQDELRGTFIGGRWRYRQLQDFLKYKTQEMGIELRQVNPKYTSRRCSKCGFIHKDFDRDYRNRHSENGKPAQFVCPNPDCKYESDPDYNAARNLATLDIEEQIRVQCQKQGLEYDSKKDKNAL

SEQ ID NO: 19 - protein, 472 aa, Artificial Sequence
  Description of Artificial Sequence: Synthetic polypeptide
  CasM.293576
MKEKSKTLVKVARLRILKPAGDMTWSELGEMLRTVRYRVFRLANLAVSEAYLGFHMFRTQRAAEFKAETMGKLSRRLREMLIEEGVDEKELNCYSLTGAVPDTVAGALHQYKIRGITSPTKWRQVVRGQAALPTFRNDMSIPIRCDKPYQRRLEKTEAGEVEVELMICRKPYPRIVLGTADVGPGQEVILERLLQNKDNSSDGYRQRLFEAKQDRQTGKWWLYVTYDFPRPEEGELNPEIVVGVDLGFSVPLYVAINNGYARLGRRHFQALGNRIRSLQRQVLARRRSIQRGGRVNISHDTARSGHGIKRKLLPTEKLRGRIEKSYSTLNHQLSASVIDFTKNHHAGTIQIEDLANLKEVLAGTFIGARWRYHQLQQFLKYKADEAGITLKEVNPRYTSRRCSECGFIHKDFDRAFRDSGRTDGKVARFVCPECGYGPVDPDYNAAKNISTLDIEKHIRVQCKKQGLEYEVH

SEQ ID NO: 20 - protein, 470 aa, Artificial Sequence
  Description of Artificial Sequence: Synthetic polypeptide
  CasM.294537
MKEKAKTLVKVARLRILKPAGDMTWPELGNMLRTVRYRVFRLANLAVSEAYLGFHMFRTKRAEEFKAETMGKLSRRLREMLIEEGVDEKDLSRYSQTGAVPDTVAGALSQYKIRGITSPTKWRQIVRGQVALPTFRNTMSIPVRCDKLYQRRLEQGDSGEVEVELMICRNPYPRVVLGTGDLNPGQQAILERLLQNTDNSADGYRQRLFEIKEDVQTRKWWLYVTYDFPKTTGKLNPEIVVGVDLGFSIPLYVALNSGHARLGYLHFKALGERIKSLQKQVMARRRAIQRGGRVSISHSTARTGHGVKRKLQPTEKLRGRIEKSYSTLNHQLSASVIDFAKNHHAGVIQIEDLSGLKEQLTGTFIGARWRYHQLQQFLKYKAEEAGITLKQINPRYTSRRCSECGFINMDFDRAFRDAGRTYGKVTKFLCPECGYEADPDYNAARNIATLDIEKLIRVQCEKHGLKFDAH

SEQ ID NO: 21 - protein, 468 aa, Artificial Sequence
  Description of Artificial Sequence: Synthetic polypeptide
  CasM.298538
MAKKAKTMFKVTNFRILKPAGDMTWKELGQLLRDARYRTFRMANLALSEAYLNFYLLKKGDLKEYKNVKIGQIAKRLRDMLIEEGVDEEVQNRFSPKVALPAYVYSALDQFKLRGLTSKSNWKKVLRGQASLPTFRLNMSVPIRCDKPEHRRLEKTENGNVEVDLMICRKPYPRVVLETLKLDGSSKAILDRLLENEDNSPGNYRQRCFEVKQNPRSNDWWLYVTYEMPVDKDKKLDPKVIVGVDLGFSVPLYVAINNGHARLGRRHFQALGKRIHNLQNQVLARRRSIQRGGQVNLSHSTSRSGHGRKRKLQPTEKLQQKINSAYSTLNHQLSSSVIDFANNHKAGTIQIEDLETLKEQLTGTYIGRQWRYYQLQQFIEYKAKENSITVKKINPKYTSRRCSMCGHIHADFDRTFRDRSSNKGFVTKFICPECNFEADPDYNAAKNISTLDIENKIKLQCKKQKIDY

SEQ ID NO: 22 - protein, 457 aa, Artificial Sequence
  Description of Artificial Sequence: Synthetic polypeptide
  CasM.19924
MPKITRKIELLFDRSGLSEEECKEKWRFIYQINDNLYRVANRLVNQLYLADEIDDILRLSDQEYIALRKKLANKKLDEATRISLEEQMSQVMKRVNERRSAILQRPQQSFAYSVVTDSDTEGLTAKILDVLKQDVLSHYKADTKEVLKGEKSISNYKKGMPIPFAFNDSLRLYKEDGFFYLKWYNGIRFLLNFGRDASNNQLIVERCLGISKDEISYKACSSSIQIKKKGNHSKIFLLLVVDVPVEQYAQKPNMVVGVDLGLNVPIYAASNSTLERKAIGSREAFLNQRGAFQRRFRALQRLQTTKGGRGRLHKLEPLERVREAERNWVRTQNHLFSREVINFAIDVGASTIQMEKLANFGRDAQGEVREDKKYVLRNWSYFELQNLIEYKAKRAGIKVKYINPAFTSQTCSECGQLGERDSIHFKCTNPDCPNCGKDIHADYNGARNIAKSKDYIK

SEQ ID NO: 23 - protein, 468 aa, Artificial Sequence
  Description of Artificial Sequence: Synthetic polypeptide
  CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 24 - protein, 468 aa, Artificial Sequence
  Description of Artificial Sequence: Synthetic polypeptide
  CasM.274559
MPTITRKIELTLCTDGLSEEQRKEQWGLLYHINDNLYKAANNISSKLYLDDHVSSMVRMKHAEYLSLLKELARAEKQKTPDADAIAELKKKVAATEKEMTDQEHAICKYATEMSTQSLSYRFSTEFETKIFAKILDCLKQGVFATFNSDAKDVKRGERAIRNYKKGMPIPFAWTDSLRIKKDNKDFYLLWYNGLRFLFNFGKDRSNNRLIVERCLKMDADYDGEYKLCNSSIQIAKREGKVKLFLLLVVSIPKEHVELNKKVVVSVDLGINVPAYVATNITEERKAIGDREHFLNSRMAFQRRYKSLQRLKGTTGGKGRTKKLEPLERLRKAEHNWVHTQNHLFSREVVDFAVKTHAATIHMEDLSGFGKDNDGNADERKEFVLRNWSYYELQNMISYKAAKYGIKVEKIRPAYTSKTCSWCGQHGFREGVTFICENPACKQCGEKVHADYNAARNIANSKEIIKKNE

SEQ ID NO: 25 - protein, 469 aa, Artificial Sequence
  Description of Artificial Sequence: Synthetic polypeptide
  CasM.286251
MPTITRKIELTLCTEGLSDQERKDQWNLLYHINDNLYRAANNISSKLYLDDHVGSMVRLKHAEYLSLLRALEKAKKQKAPDEEVIAELSQQVATAEQEMDEQAKAICQYATEMSTQTLSYRFATELETNIFGQILTCLRQGVFSTFNSDARDVKRGERSIRTYKKGMPIPFPWNDSLRIGFEDGEFYLRWYNGLRFRFDFGKDRSNNCLIVQRCMKMDKDYEGDYKLCNSSIQMVKREGKPKFFLLLVVNIPQERVELNKNIVVGVDLGINAPAYVATNTTPERKQIGDREHFLNERMAFQRRFKSLQRLKGTTGGRGRAKKLEPLERLRKAEQNWVHTQNHLFSREVIDFAVKARAATIHMEDLSGFGKDNDGNADERKEFVLRNWSYYELQNMITYKAAKYGIKVEKIRPAYTSKTCSWCGHQGFREGITFICENPECKKFGEKEHADYNAARNIANSKEIIKNNEE

SEQ ID NO: 26 - protein, 468 aa, Artificial Sequence
  Description of Artificial Sequence: Synthetic polypeptide
  CasM.288480
MPTITRKIELTLLTEGLSEEQRKEQWGLLYHINDNLYKAANNISSKLYLDDHVSTMVRMKHAEYLSLLRELARAEKQKKPDVDAIAELREKVTAAEKEMSDQERAICTYATEMSTQSLSYRFATEIETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIVKREGKVKLFLLLVVSIPQEHVELNKKIVVGVDLGINVPAYVATNITEERKAIGDREHFLNSRMAFQRRYKSLQRLKGTAGGKGRTKKLEPLERLRKAEHNWVHTQNHLFSREVVDFAVKSHAATIHMEDLSGFGKDNDGNADERKEFVLRNWSYYELQNMIAYKAAKYGIKVERIRPAYTSKTCSWCGQLGFREGVTFICENPECKQCGEKVHADYNAARNIANSKDIIKKNE

SEQ ID NO: 27 - protein, 463 aa, Artificial Sequence
  Description of Artificial Sequence: Synthetic polypeptide
  CasM.288668
MPTMTRKIELKLCTEGLSDEERKAQLGLLYHINDNLYKAANNISSKLYLDDHVSSMVRLKHAEYLSLLNEFEKAKKKGDEEQIVELSLRVAAAEKELTDQELAICKYATEMSTDTLAYRFANEIEINVFGQILACLKQGIHSTFKKDAADVKRGERAIRNFKKGMPIPFPWSKSIRIENEGSDFYLRWYNGLRFRFDFGKDRSNNRLIVSRCLNLDPDFEDEYKLSNSSLQMVKRDGRPKLFLLLVVNIPQENVELNKKIVVGVDLGINSPAYVATNITMERQRIGSRDTFLNARMAIQRRFQSLQKLQNTAGGRGRKKKLEPLERLKETERNWVRTQNHLFSRDVVQFAVKTRAATIHMEDLSGFGKDDDGNADEKKEFVLRNWSYYELQTMIKYKAAKYGIKVEKIRPAYTSRTCSWCGHEGDRKGETFICENPECEKYGKKENADYNAARNIANSTDIIK

SEQ ID NO: 28 - protein, 468 aa, Artificial Sequence
  Description of Artificial Sequence: Synthetic polypeptide
  CasM.289206
MPTITRKIELTLCTEGLSDEQRKEQWGLLYHINDNLYKAANNISSKLYLDEHVSSMVRMKHAEYLSLLKELARAEKQQTPDEGLIAELSRKLSAAEKEMADQELAICKYATEMSTQTLSYNFAKEIETNIFGQILTCLRQGVYATFNSDAKDVKRGERAIRNYKKGMPIPFPWNNSLKIESDSGEFYLRWYNGLRFLLTFGKDRSNNRMIVNRCMKMDEDFEGEYKLCNSSIQLAKRDGKPKLFLLLVVNIPQEHVKLNKKIVVGVDLGVNVPAYVATNITEERKAIGDREHFLNTRMAFQRRYKSLQRLKGTAGGKGRTKKLEPLERLRDAERNWVHTQNHLFSREVVNFAVQARAATIHMEDLSGFGKDKDGNADEKKEFVLRNWSFYELQNMIAYKSAKYGIKVVKIRPAYTSKTCSWCGQQGDRKSTTFICENPKCKHYGESIHADYNAARNIANSNDIVKENE

SEQ ID NO: 29 - protein, 467 aa, Artificial Sequence
  Description of Artificial Sequence: Synthetic polypeptide
  CasM.290598
MPKITRKIEMTLCTEGLSDEQRKEQWGLLYHINDNLYKAANNISTKLYLDEHVSSMVRMKHADYLSLLKELAKAEKKSPDEDLIAELREKLAAAEQEMTDQELAICKYATEMSTQTLAYKFATEIEINVFGQILACLKQAAQSNFKSDAKDVKRGERAIRNYKKGMPIPFPWNDNIRIDADGDEFYLRWYNGLRFHLTFGKDKSNNRMIVKRCLKMDKDFEGEYKLCNSSIQMVKRDGKPKLFLLLVVNIPQEHVELNKNVVVGVDLGVNVPAYVATNITEERKAIGEREHFLNTRMQIQRRYKSLQRLKATAGGKGRTKKLEPLERLRKAEHNWVHTQNHLFSREVVNFAVQTHAATIHMEDLSGFGKDDDGNADEQKEFVLRNWSFYELQNMIAYKAAKYGIKVEKVKPAYTSKTCSWCGQLGFRQGVTFICENPACKQCGEKVHADYNAARNIANSKDIIKKNE

SEQ ID NO: 30 - protein, 469 aa, Artificial Sequence
  Description of Artificial Sequence: Synthetic polypeptide
  CasM.290816
MPTITRKIELHLCTDGLTDEQQKAQRLLLYHINDNLYKAANNVSSKLYLDEHVSSMVRLKHDEYLSLSRELARAEKKHDDELTTELRGKLAAAEREMTDQELAICKYATEMSTQSLSYRLVTELETKIFAKILDCLKQGVYATFNSDARDVKRGERAIRNYKKGMPIPFAWNDSVRIEYDEKEKDFYLRWYNDIRFKFHFGRDRSNNRLIVSRCLKLDKDYEGDYQLCNSSIQIVKRDGSTKFFLLLVVKIPQEHVELNKRIVVGVDLGINYPAYVATNCTEERMYIGDREHFLNTRMQFQRRYKSLQKLKGTAGGKGRSKKLEPLERLRNAERNWVHTQNHLFSLKVVNFAVQTHAATIHLEDLSGFGKDDDGNADERKEFVLRNWSYYELQSMIEYKAKKYGIKVEKIRPAYTSQTCSWCGQRGFRQGVTFICENPECKKCGEKENADYNAARNIANSKDVIKDKNE

SEQ ID NO: 31 - protein, 491 aa, Artificial Sequence
  Description of Artificial Sequence: Synthetic polypeptide
  CasM.295071
TPFVLYFQNYSLSLRQHITLYSMPTITRKIELTLCTEGLSDQERKDQWNLLYHINDNLYRAANNISSKLYLDDHVGSMVRLKHAEYLSLLRAMEKAKKQKAPDEEVIAELSQQVAAAEQEMDEQAKAICQYATEMSTQTLSYRFATELETNIFGQILTCLRQGVFSTFNSDARDVKRGERSIRTYKKGMPIPFPWNDSLRIGFEDGEFYLRWYNGLRFRFDFGKDRSNNRLIVQRCMKMDKDYEGDYKLCNSSIQMVKREGKPKFFLLLVVNIPQERVELNKNIVVGVDLGINAPAYVATNTTPERKQIGDREHFLNERMAFQRRFKSLQRLKGTTGGRGRAKKLEPLERLRKAEQNWVHTQNHLFSREVIDFAVKARAATIHMEDLSGFGKDRDGNADERKEFVLRNWSYYELQNMITYKAAKYGIKVEKIRPAYTSKTCSWCGHQGFREGITFICENPECKKFGEKEHADYNAARNIANSKEIIKNNEE

SEQ ID NO: 32 - protein, 469 aa, Artificial Sequence
  Description of Artificial Sequence: Synthetic polypeptide
  CasM.295231
MPTITRKIELHLCTEELSDEQQKAQRLLLYHINDNLYKAANNVSSKLYLDEHVSSMVRLKHDEYLSLLRELARAEKKADDELATQLREKLVAAEREMTDQELAICKYATEMSTQSLSYRFVTELETKIFAKILDCLKQGVYATFNSDSRDVKRGERAIRNYKKGMPIPFAWDKSVRIEYEEKEKDFFLRWYNDIRFKFHFGRDRSNNRLIVSRCMKLDKDYEGDYQLCNSSIQIVKRDGSTKYFLLLVVKIPQEHVELNKKIVVGVDLGINYPAFAATNCTEERMSIGDREHFLNTRMQFQRRFKSLQRLKGTTGGKGRNKKLEPLERLRKAEHNWVHTQNHLFSLKVVNFAVQAHAATIHLEDLSGFGKDDDGNADERKEFVLRNWSYYELQNMIKYKAKKFGIQVEKIRPAYTSQTCSWCGQRGFRQGITFICENPECKKCGEKENADYNAARNIANSKDIIKDKDE

SEQ ID NO: 33 - protein, 460 aa, Artificial Sequence
  Description of Artificial Sequence: Synthetic polypeptide
  CasM.292139
MPIITRKIELHISKEGLSAEDYKAQWQYLRQINDNLYMAANRVSSHCFLNDEYKYRLCLQIPDYIDIEKQLKDSKRARLSKEELGQLKKRKKELENTVKGRFQDEFEKNSLYTIISNEFGEIIPGQILTCLRQCVQSKYNRAKEELEKGERAISTYKKGMPIPFPINKSIRLQKQGEDFVLKWYNKIVFKLHFGRDRSNNRVIVERLIQSALNDKQKGEDYVMNNSSIQLVEKDKMTKIFLLLSMDIPTQKRKLDSELVLGVDLGLNFPLYYATNQSANIHDHIGDKDIFLKERMVFQRRFKELQRLQCTQGGRGRKKKLEPLEKLRDKERNWVRTKNHIFSREVIKVALHLGAGTIHLENLHNFGKDGNGELKNSKKFVFRNWSYFELQSMIEYKAKMEGITVKYVNPAYTSQTCSVCGMIGERKEQAVFRCMNSSCLEYGKEVNADFNAARNIAKAKM

SEQ ID NO: 34 - protein, 466 aa, Artificial Sequence
  Description of Artificial Sequence: Synthetic polypeptide
  CasM.279423
MPTITRKIELTLCTDGLSDDLRKDQWQLLYHINDNLYKAANNISSKLYLDEHVASMVRLKHAEYLGLIKELAKARKRADDEAVRDLCSKLAVAEQEMNEQAKAICDYATEMSTQTLSYNFAKEIETNIFGQILTCLRQGVLLNFNSDARDVKRGERAIRNYKKGMPIPFPWNDTIKIVSEGDEFYLRWFSGLRFHLNFGKDRSNNRMIVRRCLKMEQDFDEEYKISNSSIQVAKRDGKQKLFLLLVVQIPQEQVVLNKKIVVGVDLGVNVPAYVATNITEERKAIGDREHFLNTRMQFQRRYKSLQRLKTTEGGRGRAKKLEPLERLRKAEHNWVHTQNHLFSREVVNFALQTQAATINMEDLSGFGKDNDGNADECKEFVLRNWSYYELQNMIVYKASKYGIRVQKIRPAYTSKTCSWCGHMGFREGVTFICENPDCKQFGEKVHADYNAARNIANSKEIIKNDE

SEQ ID NO: 35 - protein, 444 aa, Artificial Sequence
  Description of Artificial Sequence: Synthetic polypeptide
  CasM.20054
MSKTVTKTVKIALICEHTNKYGEKVDYKDINKLLWKLQKQTRELKNKTIQLCWEYNNFSCDYYKEHHEYPNMEDILKYKRINGFVENKLKTVNDLYSSNCSTTILSTCNEFQNYRSEFLKGTRSINSYKSDQPLDLHKGAIKLEHDGKDFYVSLKLLKRSAFNAMEFKGSDIRFKLNVKDKDKSTLKILESCYDKIYSISASKMTYDRKAGKWFLLLAYSFTPAKTENLDPEKILGVDLGIKIPICASVYGDLDRLTIEGGKIEEFRRRVEARKRSLQKQGKQCGDGRIGHGTKKRIKPITDIGDKIARFRDTENHIYSRYLIEYAVKKGCGTIQMEKLEGITREKDIFLKNWTYFDLQKKIEYKAKEKGIKVVYIEPAYTSKRCSSCGFIDTDNRLDQAHFKCLKCGFNENADYNASQNIGIKNIDKIIKEEHKSASDKLTSE

SEQ ID NO: 36 - protein, 439 aa, Artificial Sequence
  Description of Artificial Sequence: Synthetic polypeptide
  CasM.282673
VIILTKVVKLYLISEQINKEGQKIDYQRINSILWDLQKQTRDIKNRTVQLCWEWMNFSSDYCKTQEEYPKERDILGYTLEGYVYDYFKTGYDLYTGNISTSSREVCSSFKNVKKEILKGERSILSYKANQPLDLHKKAISLEYDNFNFFVKLKLLNRTGKKKYDITEDINFKIQVNDKSTRTILERCYDKEYKISGSKLIYEKKKKLWRLNLCYSFENSQVETLEKDKILGIDLGIVYPLMASIYGEYDRFSIKGGEIEEFRRRTEARKRSILQQTKYCGDGRIGHGRNKRTQPAYKINDKIARFRDTANHKYSRALIEYAVKKNCGIIQMENLTGISDNTDCFLKDWSYYDLQTKIENKAKEMGIKVVYIKAQYTSQRCSRCGYIDVNNRIRQALFKCQNCGYETNADYNASQNIGMYDIENIIEETLKIQSANVKQS

SEQ ID NO: 37 - protein, 437 aa, Artificial Sequence
  Description of Artificial Sequence: Synthetic polypeptide
  CasM.282952
MTKVTKVYLISEQIDKDGNKIDFKKISELLWNLQMQTRDIKNKCVQLCWEWLNFSSDYYKKSEEYPKEKDTLGYTLSGFVYDRIKNGSDLYSSNLSTSSRDTCTAFSNYKKEMLKGERSVLSFKANQPLDIHNKAIKLSYENGNFFVALKMLNRAGKEKYGIKDDLRFRMQVRDKSVRTILERLMNDEYKVSASKLMYDKKKKLWKLNLCYSFDNHVISTLDTEKIMGVDLGVVYPIMASVNGDYARFSIKGGEIEAFRSRVEARRRSLLNQSRYCGDGRIGHGRKKRTEPATQIADKIARFRDTTNHKYSRALIDYAIKNGCGTIQMEKLTGITSSAEHFLKEWSYFDLQTKIESKAKEAGIKVVYINPKFTSQRCNKCGYIHTDNRPVQARFCCQKCGYEENADYNASQNIGTKHIDVIIEETLKMQCEPETPTE

SEQ ID NO: 38 - protein, 428 aa, Artificial Sequence
  Description of Artificial Sequence: Synthetic polypeptide
  CasM.283262
MNKVVKLALICEQSDKDNSPVDYKKINEILWELQKQTREIKNKAIQYCWEYNNFSSDYYKKFNEYPKEKDILSYTLVGFVNDKFKTGNDLYSGNCSTTVRNACTEFKNSKKELIKGSRSIINYRSNQPLDIHNKCIRIEFENNCFYTYLKLLNRPAFKKYNFANTEIKFKILVRDNSTKTILERCISNEYEIAASKLLYDQKKKCWFLNLVYAFEIKSNNSLDPNKILGVDLGIHYPICASVYGSLDRFTIDGGEIDEFRRRVESRKISMLKQGKNCGDGRIGHGIKARNKPVYNIEDKIARFRDTANHKYSRALIEYAVKHTCGTIQMEDLTGITDIANRFLKNWSYYDLQTKIEYKAKEAGINIVYIDPKNTSRRCSKCGYIDKENRETQSRFICLKCGFKENADYNASQNIGIKDIDKLIKEDVH

SEQ ID NO: 39 - protein, 443 aa, Artificial Sequence
  Description of Artificial Sequence: Synthetic polypeptide
  CasM.284833
VTLLVKVVKIYLISEQFDKAGNQIDYKEVNKILWELQKQTREAKNKTVQLLWEWNNFSSDYVKASGIYPKAKDIFGYSSVHGQANKELRTKLALNSSNLSTTTMDVCKIFNTYKKEVWEGKRSVPSYKSDQPLDLHKESIKLIYENNEFYVRLALLKKAEFAKYGFKDGFRFKMQVKDNSTKTILERCFDEVYKINASKLLYDQKKKKWKLNLSYSFDNKNISELDKEKILGVDVGVNCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 40 - protein, 428 aa, Artificial Sequence
  Description of Artificial Sequence: Synthetic polypeptide
  CasM.287700
MNKVVKLALICEQSDKNNSPVDYKKVNEILWELQKQTREIKNKTIQYCWEYYNFSSDYYKKFNKYPKEKDILSYTLWGFINDKFKTGNDLYSGNCSATTKKVIKEFKNSKKELIRGSRSIINYKSNQPLNIHNKCIHLQFKNNNFYVSINLLNRRSFKKYNFANTAIKFKILVRDNSTKAILERCISNEYKISESQLIYNKKKKCWFLNLSYAFEIKSNNSLDPNKILGVDLGIHYPICASVYGSLDRFTIDGGEIDEFRRRVESRKISMLKQGKNCGDGRIGHGIKARNKPVYNIEDKIARFRDTANHKYSRALIEYAVKNNCGTIQMEDLTGITDNANRFLKNWSYYDLQTKIEYKAKEASINVVYINPENTSRRCSKCGYIDKENRKTQSSFICLKCGFKENADYNASQNISIKDIDKLIKEDVH

SEQ ID NO: 41 - protein, 443 aa, Artificial Sequence
  Description of Artificial Sequence: Synthetic polypeptide
  CasM.291507
VTLLVKVVKIHLISEQFDKAGNRIDYEEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNQFYVRLALLKKAEFAKYGFKDGFHFKMQVKDNSTKTILERCFDEVYKINASKLLYDQKKKKWKLNLSYSFDNKNISELDKEKILGVDVGVSYPLVASVFGDRDRFKIKGGEIEKFRKSVEARRRSMLEQTKYCGDGRIGHGRKKRTEPALNIGDKIARFRDTTNHKYSRALIEYAVKKGCGTIQMEKLTGITSKADRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 42 - protein, 449 aa, Artificial Sequence
  Description of Artificial Sequence: Synthetic polypeptide
  CasM.293410
LIWKDALGGIILTKIVKLYLISEQIDKDGNRVDYKEINSILWNLQKQTRDIKNKTVQLCWEWMNFSSDYYKKNELYPNEKEILNLTLRGYAYDHFKQGYDLYSSNISVLTEAVCGAFKNAKKEMLNGEKSVLSYKAEQPLDIHKKCIKLEYDKNFYVKLKMLNKAGKKKYGIEDDLNFKIQVEDKSTRTILERCIDGEYVVSGSKLIYDKKKKLWKLNLCYSFKANEIESLDKNKILGIDLGIACPLMASVNGEFDRFSIKGGEIETFRKRIEARKRSVLHQTKYCGDGRIGHGRNKRTEPAYKINDKIARFRDTANHKYSRALIDYAIRKNCGMIQMENLTGISDKKEHFLKEWSYYDLQTKIENKAKEKGIKIVYINPEYTSQRCSKCGYIDANNRELRAVFKCQKCGFEADADYNASQNIGIKNIEDIIENTLKISSANEKQTKNT

SEQ ID NO: 43 - protein, 462 aa, Artificial Sequence
  Description of Artificial Sequence: Synthetic polypeptide
  CasM.295105
VFYSTFLCYILTKYIDFSANECYNINTSSEVKQLMNKVVKLALICEQSDKDNSPVDYKKINEILWELQKQTREIKNKAIQYCWEYNNFSSDYYKKFNEYPKEKDILSYTLVGFVNDKFKTGNDLYSGNCSTTVRNACTEFKNSKKELIKGSRSIINYRSNQPLDIHNKCIRIEFENNCFYTYLKLLNRPAFKKYNFANTEIKFKILVRDNSTKTILERCISNEYEIAASKLLYDQKKKCWFLNLVYAFEIKSNNSLDPNKILGVDLGIHYPICASVYGSLDRFTIDGGEIDEFRRRVESRKISMLKQGKNCGDGRIGHGIKARNKPVYNIEDKIARFRDTANHKYSRALIEYAVKHTCGTIQMEDLTGITDIANRFLKNWSYYDLQTKIEYKAKEAGINIVYIDPKNTSRRCSKCGYIDKENRETQSRFICLKCGFKENADYNASQNIGIKDIDKLIKEDVH

SEQ ID NO: 44 - protein, 430 aa, Artificial Sequence
  Description of Artificial Sequence: Synthetic polypeptide
  CasM.295187
LISEQIDKDGNRVDYKEINSILWNLQKQTRDIKNKTVQLCWEWMNFSSDYYKKNELYPNEKEILNLTLRGYAYDHFKQGYDLYSSNISVLTEAVCGAFKNAKKEMLNGEKSVLSYKAEQPLDIHKKCIKLEYDKNFYVKLKMLNKAGKKKYGIEDDLNFKIQVEDKSTRTILERCIDGEYVVSGSKLIYDKKKKLWKLNLCYSFKANEIESLDKNKILGIDLGIACPLMASVNGEFDRFSIKGGEIETFRKRIEARKRSVLHQTKYCGDGRIGHGRNKRTEPAYKINDKIARFRDTANHKYSRALIDYAIRKNCGMIQMENLTGISDNKEHFLKEWSYYDLQTKIENKAKEKGIKIVYINPEYTSQRCSKCGYIDANNRELRAVFKCQNCGFEADADYNASQNIGIKNIEDIIENTLKISSANEKQTKNT

SEQ ID NO: 45 - protein, 429 aa, Artificial Sequence
  Description of Artificial Sequence: Synthetic polypeptide
  CasM.295929
LVKVVKIYLISEQVDEQGKDVDYNTICGVLWDLQWETREIKNKTVQLCWEWSGFSSDYYKKYGEYPKEKNLLDYTMGGFVYDKLKSKYHLYTANLSTTSQNTCGIFRTYKVDFVKGNRSVLSFKADQPLDVHKKSISIDRIDDNYFVKLKLLNKSGIQKYGIRDDFHFRMLVKDNSTKTILERCVGGDYKAAASKIIYDKKKKMWCLNLSYEFDVNTAKDLNKNRILGIDIGIVYPVVASVNGELDRFVIQGGEIETFRRRVENRKKSLLKQTKYCGDGRIGHGRNKRTEPVDIISDQIARFRNTANHKYSRAVIDYAVRKQCGTIQMENLKGITDKSDRFLKNWSYYDLQQKIEYKAKEKGINVVFINPKYTSQRCSRCGYIDSANRPKLPNQSKFLCIKCGFTENADYNASQNIALYNIEKLIDAEA

SEQ ID NO: 46 - RNA, 53 nt, Artificial Sequence
  Description of Artificial Sequence: Synthetic oligonucleotide
  CasM.298706 guide nucleic acid
cguugcagcucgcacguuggcacugguugaagguauuaaauacucguauugcu

SEQ ID NO: 47 - RNA, 52 nt, Artificial Sequence
  Description of Artificial Sequence: Synthetic oligonucleotide
  CasM.280604 guide nucleic acid
guugcaacucacgcgcguauguggcuugaagguauuaaauacucguauugcu

SEQ ID NO: 48 - RNA, 52 nt, Artificial Sequence
  Description of Artificial Sequence: Synthetic oligonucleotide
  CasM.281060 guide nucleic acid
guugcaauucauaucuccggguggauugaagguauuaaauacucguauugcu

SEQ ID NO: 49 - RNA, 52 nt, Artificial Sequence
  Description of Artificial Sequence: Synthetic oligonucleotide
  CasM.284933 guide nucleic acid
guugcagcgugcgcgagcguguggcuugaagguauuaaauacucguauugcu

SEQ ID NO: 50 - RNA, 52 nt, Artificial Sequence
  Description of Artificial Sequence: Synthetic oligonucleotide
  CasM.287908 guide nucleic acid
guugcaacucgcacgugaaugcgacuugaagguauuaaauacucguauugcu

SEQ ID NO: 51 - RNA, 52 nt, Artificial Sequence
  Description of Artificial Sequence: Synthetic oligonucleotide
  CasM.288518 guide nucleic acid
gaugcaacucguguguaugugcgaguugaagguauuaaauacucguauugcu

SEQ ID NO: 52 - RNA, 52 nt, Artificial Sequence
  Description of Artificial Sequence: Synthetic oligonucleotide
  CasM.293891 guide nucleic acid
gacgcaacucgcgcgcgggcauguauugaggguauuaaauacucguauugcu

SEQ ID NO: 53 - RNA, 52 nt, Artificial Sequence
  Description of Artificial Sequence: Synthetic oligonucleotide
  CasM.294270 guide nucleic acid
gaugcaucugacacagcugggugaguugaagguauuaaauacucguauugcu

SEQ ID NO: 54 - RNA, 52 nt, Artificial Sequence
  Description of Artificial Sequence: Synthetic oligonucleotide
  CasM.294491 guide nucleic acid
guugcaacacauguaugugggugaguugaagguauuaaauacucguauugcu

SEQ ID NO: 55 - RNA, 52 nt, Artificial Sequence; identical to SEQ ID NO: 49
  Description of Artificial Sequence: Synthetic oligonucleotide
  CasM.295047 guide nucleic acid

SEQ ID NO: 56 - RNA, 52 nt, Artificial Sequence
  Description of Artificial Sequence: Synthetic oligonucleotide
  CasM.299588 guide nucleic acid
guugcaauuuguauacgagugugacuugaagguauuaaauacucguauugcu

SEQ ID NO: 57 - RNA, 52 nt, Artificial Sequence
  Description of Artificial Sequence: Synthetic oligonucleotide
  CasM.277328 guide nucleic acid
gcugcaacacgcgcggguacgcggguugaagguauuaaauacucguauugcu

SEQ ID NO: 58 - RNA, 52 nt, Artificial Sequence
  Description of Artificial Sequence: Synthetic oligonucleotide
  CasM.297894 guide nucleic acid
guugcaacucgcacguuggcacugauugaagguauuaaauacucguauugcu

SEQ ID NO: 59 - RNA, 54 nt, Artificial Sequence
  Description of Artificial Sequence: Synthetic oligonucleotide
  CasM.291449 guide nucleic acid
gcuguagcccugcucaaauuguagggcgcaugcagguauuaaauacucguauug

SEQ ID NO: 60 - RNA, 56 nt, Artificial Sequence
  Description of Artificial Sequence: Synthetic oligonucleotide
  CasM.297599 guide nucleic acid
guuguagucgaccugaaucuguggggugcuuacagguauuaaauacucguauugcu

SEQ ID NO: 61 - RNA, 56 nt, Artificial Sequence
  Description of Artificial Sequence: Synthetic oligonucleotide
  CasM.286588 guide nucleic acid
gguguauguaaccgcaauuugaagggugcauacagguauuaaauacucguauugcu

SEQ ID NO: 62 - RNA, 56 nt, Artificial Sequence
  Description of Artificial Sequence: Synthetic oligonucleotide
  CasM.286910 guide nucleic acid
guuggaaucgaccuuaauuugaggugugcuuacagguauuaaauacucguauugcu

SEQ ID NO: 63 - RNA, 56 nt, Artificial Sequence
  Description of Artificial Sequence: Synthetic oligonucleotide
  CasM.286910 guide nucleic acid
gcugaaagagcagagaauuuguugugugcauacagguauuaaauacucguauugcu

SEQ ID NO: 64 - RNA, 56 nt, Artificial Sequence
  Description of Artificial Sequence: Synthetic oligonucleotide
  CasM.293576 guide nucleic acid
guuggagucggcuugaaucugcggggugcuuacagguauuaaauacucguauugcu

SEQ ID NO: 65 - RNA, 56 nt, Artificial Sequence; identical to SEQ ID NO: 62
  Description of Artificial Sequence: Synthetic oligonucleotide
  CasM.294537 guide nucleic acid

SEQ ID NO: 66 - RNA, 56 nt, Artificial Sequence
  Description of Artificial Sequence: Synthetic oligonucleotide
  CasM.298538 guide nucleic acid
guuguaagagacccgaauuuuagcuguguauacagguauuaaauacucguauugcu

SEQ ID NO: 67 - RNA, 56 nt, Artificial Sequence
  Description of Artificial Sequence: Synthetic oligonucleotide
  CasM.19924 guide nucleic acid
guugugaaugcaggcauuuuugaugguaaauccaacuauuaaauacucguauugcu

SEQ ID NO: 68 - RNA, 56 nt, Artificial Sequence
  Description of Artificial Sequence: Synthetic oligonucleotide
  CasM.19952 guide nucleic acid
acugucagacaaugcaaaaugugugguacauccaacuauuaaauacucguauugcu

SEQ ID NO: 69 - RNA, 56 nt, Artificial Sequence
  Description of Artificial Sequence: Synthetic oligonucleotide
  CasM.274559 guide nucleic acid
gcugucaguaguaguaaaaauggggguacauccaacuauuaaauacucguauugcu

SEQ ID NO: 70 - RNA, 56 nt, Artificial Sequence
  Description of Artificial Sequence: Synthetic oligonucleotide
  CasM.286251 guide nucleic acid
acugucaguacaugcaaaaaugaggguacauccaacuauuaaauacucguauugcu

SEQ ID NO: 71 - RNA, 56 nt, Artificial Sequence
  Description of Artificial Sequence: Synthetic oligonucleotide
  CasM.288480 guide nucleic acid
acugucagacaaugcaaaaugagugguacauccaacuauuaaauacucguauugcu

SEQ ID NO: 72 - RNA, 56 nt, Artificial Sequence
  Description of Artificial Sequence: Synthetic oligonucleotide
  CasM.288668 guide nucleic acid
gcuguuagaacauacaaaaugaaagguacauccaacuauuaaauacucguauugcu

SEQ ID NO: 73 - RNA, 56 nt, Artificial Sequence
  Description of Artificial Sequence: Synthetic oligonucleotide
  CasM.289206 guide nucleic acid
gcugcaugucauggcaaaaggaaagguacauccaacuauuaaauacucguauugcu

SEQ ID NO: 74 - RNA, 56 nt, Artificial Sequence
  Description of Artificial Sequence: Synthetic oligonucleotide
  CasM.290598 guide nucleic acid
gcugucagacaccuaaaaaaugaggguacauccaacuauuaaauacucguauugcu

SEQ ID NO: 75 - RNA, 56 nt, Artificial Sequence
  Description of Artificial Sequence: Synthetic oligonucleotide
  CasM.290816 guide nucleic acid
gcugugagucacaguaaaaaugaagguauauccaacuauuaaauacucguauugcu

SEQ ID NO: 76 - RNA, 56 nt, Artificial Sequence; identical to SEQ ID NO: 70
  Description of Artificial Sequence: Synthetic oligonucleotide
  CasM.295071 guide nucleic acid

SEQ ID NO: 77 - RNA, 56 nt, Artificial Sequence; identical to SEQ ID NO: 75
  Description of Artificial Sequence: Synthetic oligonucleotide
  CasM.295231 guide nucleic acid

SEQ ID NO: 78 - RNA, 56 nt, Artificial Sequence
  Description of Artificial Sequence: Synthetic oligonucleotide
  CasM.292139 guide nucleic acid
gauguauaugcuaugauuuuguaugguacauccaacuauuaaauacucguauugcu

SEQ ID NO: 79 - RNA, 56 nt, Artificial Sequence; identical to SEQ ID NO: 69
  Description of Artificial Sequence: Synthetic oligonucleotide
  CasM.279423 guide nucleic acid

SEQ ID NO: 80 - RNA, 53 nt, Artificial Sequence
  Description of Artificial Sequence: Synthetic oligonucleotide
  CasM.20054 guide nucleic acid
guugagcucugcauuacgcagaugaaugacgaguauuaaauacucguauugcu

SEQ ID NO: 81 - RNA, 131 nt, Artificial Sequence
  Description of Artificial Sequence: Synthetic polynucleotide
  CasM.282673 guide nucleic acid
auaagggcggcucagcguccuaaagucgagaaaguaugcguaaacuucuuucauagaauugcagauacucucggcaagguaaaaacccuacaaauuuaauccuuguaggcgacuuauauuuguguauauuu

SEQ ID NO: 82 - RNA, 52 nt, Artificial Sequence
  Description of Artificial Sequence: Synthetic oligonucleotide
  CasM.282952 guide nucleic acid
guugcaaucugcguacaggcguaagaugugaguauuaaauacucguauugcu

SEQ ID NO: 83 - RNA, 52 nt, Artificial Sequence
  Description of Artificial Sequence: Synthetic oligonucleotide
  CasM.283262 guide nucleic acid
gaucauaucugcuuguauggguaugcugcgaguauuaaauacucguauugcu

SEQ ID NO: 84 - RNA, 52 nt, Artificial Sequence
  Description of Artificial Sequence: Synthetic oligonucleotide
  CasM.284833 guide nucleic acid
guugcaacuuacgcauagguguaaaauacgaguauuaaauacucguauugcu

SEQ ID NO: 85 - RNA, 52 nt, Artificial Sequence
  Description of Artificial Sequence: Synthetic oligonucleotide
  CasM.287700 guide nucleic acid
gauuauaucugcuuguauggguauacugcgaguauuaaauacucguauugcu

SEQ ID NO: 86 - RNA, 52 nt, Artificial Sequence; identical to SEQ ID NO: 84
  Description of Artificial Sequence: Synthetic oligonucleotide
  CasM.291507 guide nucleic acid

SEQ ID NO: 87 - RNA, 58 nt, Artificial Sequence
  Description of Artificial Sequence: Synthetic oligonucleotide
  CasM.293410 guide nucleic acid
ucagcucacaaccuacauaugcauacaagauauaucguuauuaaauacucguauugcu

SEQ ID NO: 88 - RNA, 52 nt, Artificial Sequence; identical to SEQ ID NO: 83
  Description of Artificial Sequence: Synthetic oligonucleotide
  CasM.295105 guide nucleic acid

SEQ ID NO: 89 - RNA, 52 nt, Artificial Sequence
  Description of Artificial Sequence: Synthetic oligonucleotide
  CasM.295187 guide nucleic acid
gauauaucuuguaugcauauguagguugugaguauuaaauacucguauugcu

SEQ ID NO: 90 - RNA, 52 nt, Artificial Sequence
  Description of Artificial Sequence: Synthetic oligonucleotide
  CasM.295929 guide nucleic acid
guugcaaugaacguaugugcaugaggugugaguauuaaauacucguauugcu

SEQ ID NO: 91 - RNA, 82 nt, Artificial Sequence
  Description of Artificial Sequence: Synthetic oligonucleotide
  CasM.298706 guide nucleic acid
ggggcgucuucccgucccuaaaucgagauagcagccauuuuucuucauuuuugaagacggucuugcacucgaaaaggucaag

SEQ ID NO: 92 - RNA, 84 nt, Artificial Sequence
  Description of Artificial Sequence: Synthetic oligonucleotide
  CasM.280604 guide nucleic acid
ggggcgacuucccgccccaaaaucgagaaagugacugucagacuuugcuaugcaaagcaaguaauacacucgagaagguaaaga

SEQ ID NO: 93 - RNA, 83 nt, Artificial Sequence
  Description of Artificial Sequence: Synthetic oligonucleotide
  CasM.281060 guide nucleic acid
agggcgacuucccguccuaaaaucgagaaagugacaauucagucucgcauuucgagcauuguaauacacucgaaaagguuaag

SEQ ID NO: 94 - RNA, 85 nt, Artificial Sequence
  Description of Artificial Sequence: Synthetic oligonucleotide
  CasM.284933 guide nucleic acid
ggggcgacuucccgucccaaaaucgagaaaguggucguaagucucgaucggaucgaagcagacaauacacucgaaaagguuaagu

SEQ ID NO: 95 - RNA, 82 nt, Artificial Sequence
  Description of Artificial Sequence: Synthetic oligonucleotide
  CasM.287908 guide nucleic acid
ggggcgacuucccgucccuaaaucgagaaaguggcgguaagacuucggucuucgaagcgcgcaauacacucgaaaagguuaa

SEQ ID NO: 96 - RNA, 83 nt, Artificial Sequence
  Description of Artificial Sequence: Synthetic oligonucleotide
  CasM.288518 guide nucleic acid
ggggcgacuucccgucccaaaaucgagaaagugacaguaauucuuuguuuuacagagguuguaauacacucgauaagguuaag

SEQ ID NO: 97 - RNA, 83 nt, Artificial Sequence
  Description of Artificial Sequence: Synthetic oligonucleotide
  CasM.293891 guide nucleic acid
ggggcgaccucccgucccaaaaucgagaaaguggccgucagacuucucgcugagaagcacgcaauacacucgaaaagguaaag

SEQ ID NO: 98 - RNA, 83 nt, Artificial Sequence
  Description of Artificial Sequence: Synthetic oligonucleotide
  CasM.294270 guide nucleic acid
agggcgacuucccguccugaaaucgagaaagugacaaggaaagcgcaauuuugcgccguuguaauacacucgagaaggucaag

SEQ ID NO: 99 - RNA, 83 nt, Artificial Sequence
  Description of Artificial Sequence: Synthetic oligonucleotide
  CasM.294491 guide nucleic acid
agggcgacuucccguccuaaaaucgagauagugacaagucagucucuuaugaggagcauuguaauacacucgagaaggucaag

SEQ ID NO: 100 - RNA, 85 nt, Artificial Sequence; identical to SEQ ID NO: 94
  Description of Artificial Sequence: Synthetic oligonucleotide
  CasM.295047 guide nucleic acid

SEQ ID NO: 101 - RNA, 83 nt, Artificial Sequence
  Description of Artificial Sequence: Synthetic oligonucleotide
  CasM.299588 guide nucleic acid
agggcgacuucacguccucaaaucgagaaagugagcguaagacuuggcuucugucaagcgguuaauacacucgagaagguuaa

SEQ ID NO: 102 - RNA, 83 nt, Artificial Sequence
  Description of Artificial Sequence: Synthetic oligonucleotide
  CasM.277328 guide nucleic acid
ggggcgacuucccgucccgaaaucgagaaagugaccgucagacucugcuuugcagagcagguaauacacucgagaagguaaag

SEQ ID NO: 103 - RNA, 83 nt, Artificial Sequence
  Description of Artificial Sequence: Synthetic oligonucleotide
  CasM.297894 guide nucleic acid
ggggcgucuucccgucccuaaaucgagauagcagccauuuuucuucauuuuuugaagacggucuugcacucgaaaaggucaag

SEQ ID NO: 104 - RNA, 135 nt, Artificial Sequence
  Description of Artificial Sequence: Synthetic polynucleotide
  CasM.291449 guide nucleic acid
cacgcuagcugaaaagcaaccgcguacacgcggacgaacggccgaccugcucggccugaagguugagaagguuauguauaagaggagaaaaucccccuucauaaucgcucaccaagcucccaauuuacauauuuu

SEQ ID NO: 105 - RNA, 97 nt, Artificial Sequence
  Description of Artificial Sequence: Synthetic oligonucleotide
  CasM.291449 guide nucleic acid
cggccgaccugcucggccugaagguugagaagguuauguauaagaggagaaaaucccccuucauaaucgcucaccaagcucccaauuuacauauuuu

SEQ ID NO: 106 - RNA, 135 nt, Artificial Sequence
  Description of Artificial Sequence: Synthetic polynucleotide
  CasM.297599 guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuuuuuu

SEQ ID NO: 107 - RNA, 96 nt, Artificial Sequence
  Description of Artificial Sequence: Synthetic oligonucleotide
  CasM.297599 guide nucleic acid
gaaggccgaccuguacggccuuaagguugagaaggcacauguaaguggaaaaaugcuuucccguuguguucgcucaccaagcacacacguuuuuuu

SEQ ID NO: 108 - RNA, 137 nt, Artificial Sequence
  Description of Artificial Sequence: Synthetic polynucleotide
  CasM.286588 guide nucleic acid
aggucgccguuuacguugcgucacaagggcgcgcgggcgaccgaaggccgaucuguacggccugcagguugagaaggcacauauuagaggaaaauugcuucccuuuguguucgcucaccgaguauuccuuguuuuuu

SEQ ID NO: 109 - RNA, 87 nt, Artificial Sequence
  Description of Artificial Sequence: Synthetic oligonucleotide
  CasM.286588 guide nucleic acid
aucuguacggccugcagguugagaaggcacauauuagaggaaaauugcuucccuuuguguucgcucaccgaguauuccuuguuuuuu

SEQ ID NO: 110 - RNA, 138 nt, Artificial Sequence
  Description of Artificial Sequence: Synthetic polynucleotide
  CasM.286910 guide nucleic acid
caauguuucgcuaaccuuuaagguaaucgcgggcaggcgacugaaggccgaccuguacggccuuaaggcugagaaggcacauguaaguggaaaaaugcuuucccguuguguucgcucaccaagcacauuuguuuuuuu

SEQ ID NO: 111 - RNA, 96 nt, Artificial Sequence
  Description of Artificial Sequence: Synthetic oligonucleotide
  CasM.286910 guide nucleic acid
gaaggccgaccuguacggccuuaaggcugagaaggcacauguaaguggaaaaaugcuuucccguuguguucgcucaccaagcacauuuguuuuuuu

SEQ ID NO: 112 - RNA, 136 nt, Artificial Sequence
  Description of Artificial Sequence: Synthetic polynucleotide
  CasM.292335 guide nucleic acid
aggccguuaucaacguuucgcggaagagcggacgaacggcugaaggccgaccuguacggccuaaagguugagaaggcacauguaagaggaaaaucgcuucccuuuguguucgcucaccggguacacgcguuuuuuu

SEQ ID NO: 113 - RNA, 93 nt, Artificial Sequence
  Description of Artificial Sequence: Synthetic oligonucleotide
  CasM.292335 guide nucleic acid
aggccgaccuguacggccuaaagguugagaaggcacauguaagaggaaaaucgcuucccuuuguguucgcucaccggguacacgcguuuuuuu

SEQ ID NO: 114 - RNA, 142 nt, Artificial Sequence
  Description of Artificial Sequence: Synthetic polynucleotide
  CasM.293576 guide nucleic acid
ucguaaauguugcgcuagccauaauggcaaucgcguacaggcaacugaaggccgaccuguacggccuuaagguugagaaggcacaugucaguggaaaaaugcuuucccuuuguguucgcucaccaagcacacgcgguuuuuu

SEQ ID NO: 115 - RNA, 95 nt, Artificial Sequence
  Description of Artificial Sequence: Synthetic oligonucleotide
  CasM.293576 guide nucleic acid
aaggccgaccuguacggccuuaagguugagaaggcacaugucaguggaaaaaugcuuucccuuuguguucgcucaccaagcacacgcgguuuuuu

SEQ ID NO: 116 - RNA, 137 nt, Artificial Sequence
  Description of Artificial Sequence: Synthetic polynucleotide
  CasM.294537 guide nucleic acid
aauguuucgcuaaccuuuaagguaaucgcgggcaggcgacugaaggccgaccuguacggccuuaaggcugagaaggcacauguaaguggaaaaaugcuuucccguuguguucgcucaccaagcacauuuguuuuuuu

SEQ ID NO: 117 - RNA, 95 nt, Artificial Sequence
  Description of Artificial Sequence: Synthetic oligonucleotide
  CasM.294537 guide nucleic acid
aaggccgaccuguacggccuuaaggcugagaaggcacauguaaguggaaaaaugcuuucccguuguguucgcucaccaagcacauuuguuuuuuu

SEQ ID NO: 118 - RNA, 148 nt, Artificial Sequence
  Description of Artificial Sequence: Synthetic polynucleotide
  CasM.298538 guide nucleic acid
ggucguuguaaaacguaacgcuagccuuauggcaaucgcgaacgaacgacugaaggccgaccuguacggccugaaggaugagaaggcacauauuagaggaaaaaaaugguucccuuugugaccgcucaccaaacacauguuuauuuuu

SEQ ID NO: 119 - RNA, 96 nt, Artificial Sequence
  Description of Artificial Sequence: Synthetic oligonucleotide
  CasM.298538 guide nucleic acid
aaggccgaccuguacggccugaaggaugagaaggcacauauuagaggaaaaaaaugguucccuuugugaccgcucaccaaacacauguuuauuuuu

SEQ ID NO: 120 - RNA, 80 nt, Artificial Sequence
  Description of Artificial Sequence: Synthetic oligonucleotide
  CasM.19924 guide nucleic acid
augaauaggauucguccuauggggcaguugguugcccuuagccugaggcauuuauugcacucgggaaguaccauuucuca

SEQ ID NO: 121 - RNA, 80 nt, Artificial Sequence
  Description of Artificial Sequence: Synthetic oligonucleotide
  CasM.274559 guide nucleic acid
augaauaggauuuauccuauggggcaguugguugcccuuagccugaggcauuuaaugcacucgggaaguaccuuuucuca

SEQ ID NO: 122 - RNA, 80 nt, Artificial Sequence
  Description of Artificial Sequence: Synthetic oligonucleotide
  CasM.286251 guide nucleic acid
aagaauaggauucauccuauggggcaguugguugcccuuagccugaggaauuuaauucacucgggaaguaccuuucucau

SEQ ID NO: 123 - RNA, 80 nt, Artificial Sequence
  Description of Artificial Sequence: Synthetic oligonucleotide
  CasM.288668 guide nucleic acid
auggauaggauucguccuauggggcaguugggaccauguaaugcccuuagccugaggaauucauuucacucgggaaguau

SEQ ID NO: 124 - RNA, 80 nt, Artificial Sequence
  Description of Artificial Sequence: Synthetic oligonucleotide
  CasM.290816 guide nucleic acid
augaauaggauuuauccuauggggcaguuggaugcccuuagccugaggcauuuauugcacucgggaaguaccuuuucuca

SEQ ID NO: 125 - RNA, 84 nt, Artificial Sequence
  Description of Artificial Sequence: Synthetic oligonucleotide
  CasM.292139 guide nucleic acid
uauuuucuaaugggguuguuggaaagagcuuuuacugaaauuuguaaaggugcccugaacuugagaauugaaaaauuacucgag

SEQ ID NO: 126 - RNA, 75 nt, Artificial Sequence
  Description of Artificial Sequence: Synthetic oligonucleotide
  CasM.292139 guide nucleic acid
augggguuguuggaaagagcuuuuacugaaauuuguaaaggugcccugaacuugagaauugaaaaauuacucgag

SEQ ID NO: 127 - RNA, 80 nt, Artificial Sequence; identical to SEQ ID NO: 121
  Description of Artificial Sequence: Synthetic oligonucleotide
  CasM.279423 guide nucleic acid

SEQ ID NO: 128 - RNA, 122 nt, Artificial Sequence
  Description of Artificial Sequence: Synthetic polynucleotide
  CasM.20054 guide nucleic acid
uucgggcggcucggcguccguaaaucgagaaagagcuuguaauuccugauucuaucaggugaagcaacacucgguaagguauaacaauacacauguauaauccguguauuuaaguucauuuu

SEQ ID NO: 129 - RNA, 85 nt, Artificial Sequence
  Description of Artificial Sequence: Synthetic oligonucleotide
  CasM.20054 guide nucleic acid
uucgggcggcucggcguccguaaaucgagaaagagcuuguaauuccugauucuaucaggugaagcaacacucgguaagguauaac

SEQ ID NO: 130 - RNA, 131 nt, Artificial Sequence; identical to SEQ ID NO: 81
  Description of Artificial Sequence: Synthetic polynucleotide
  CasM.282673 guide nucleic acid

SEQ ID NO: 131 - RNA, 84 nt, Artificial Sequence
  Description of Artificial Sequence: Synthetic oligonucleotide
  CasM.282673 guide nucleic acid
auaagggcggcucagcguccuaaagucgagaaaguaugcguaaacuucuuucauagaauugcagauacucucggcaagguaaaa

SEQ ID NO: 132 - RNA, 111 nt, Artificial Sequence
  Description of Artificial Sequence: Synthetic polynucleotide
  CasM.282952 guide nucleic acid
auucuuuccucggaaagugguagauacucucgguaagguaaacuguguaugaacaguuugaaauccugcacauaaaauccgugcaggcaucuuauaguuuugugcaucuuu

SEQ ID NO: 133 - RNA, 91 nt, Artificial Sequence
  Description of Artificial Sequence: Synthetic oligonucleotide
  CasM.282952 guide nucleic acid
auucuuuccucggaaagugguagauacucucgguaagguaaacuguguaugaacaguuugaaauccugcacauaaaauccgugcaggcauc

SEQ ID NO: 134 - RNA, 129 nt, Artificial Sequence
  Description of Artificial Sequence: Synthetic polynucleotide
  CasM.283262 guide nucleic acid
uucgggcggcucggcguccguaaaccgagaaaguauauguaagucugaauuuauucagcguuagauacacucgguaagguucaaacaauacauauucaauccauguauucaguauauuuguacauuuuu

SEQ ID NO: 135 - RNA, 86 nt, Artificial Sequence
  Description of Artificial Sequence: Synthetic oligonucleotide
  CasM.283262 guide nucleic acid
uucgggcggcucggcguccguaaaccgagaaaguauauguaagucugaauuuauucagcguuagauacacucgguaagguucaaac

SEQ ID NO: 136 - RNA, 133 nt, Artificial Sequence
  Description of Artificial Sequence: Synthetic polynucleotide
  CasM.284833 guide nucleic acid
uucagggcgacucggcguccuaaaaucgagaaaguguacauaaauuuuuaacaaaauacgguaaauacucucgguaagguuuuaacgugcacauaauaauccgugcaacaggguuacacuuuugugcaauuuu

SEQ ID NO: 137 - RNA, 86 nt, Artificial Sequence
  Description of Artificial Sequence: Synthetic oligonucleotide
  CasM.284833 guide nucleic acid
uucagggcgacucggcguccuaaaaucgagaaaguguacauaaauuuuuaacaaaauacgguaaauacucucgguaagguuuuaac

SEQ ID NO: 138 - RNA, 86 nt, Artificial Sequence
  Description of Artificial Sequence: Synthetic oligonucleotide
  CasM.287700 guide nucleic acid
uucgggcggcucggcguccguaaaccgagaaaguauauguaagucugaauuuauucagcguuagauacacucgguaagguuuaaac

SEQ ID NO: 139 - RNA, 133 nt, Artificial Sequence
  Description of Artificial Sequence: Synthetic polynucleotide
  CasM.291507 guide nucleic acid
uucagggcgacucggcguccuaaaaucgagaaaguguacauaaguuuuuaacaaaauacgguaaauacucucgguaagguuuuaacgugcacauaauaauccgugcaacaggguuacacuuuugugcaauuuu

SEQ ID NO: 140 - RNA, 87 nt, Artificial Sequence
  Description of Artificial Sequence: Synthetic oligonucleotide
  CasM.291507 guide nucleic acid
uucagggcgacucggcguccuaaaaucgagaaaguguacauaaguuuuuaacaaaauacgguaaauacucucgguaagguuuuaacg

SEQ ID NO: 141 - RNA, 133 nt, Artificial Sequence
  Description of Artificial Sequence: Synthetic polynucleotide
  CasM.293410 guide nucleic acid
uauuaagggcggcucagcguccuuaagucgagaaaguauacauaaauuucuuauauagaauaguagauacucucggcaagguauaaacccuacaaauuuaauccuuguaggcaacuuauauuuguauuuauuu

SEQ ID NO: 142 - RNA, 89 nt, Artificial Sequence
  Description of Artificial Sequence: Synthetic oligonucleotide
  CasM.293410 guide nucleic acid
uauuaagggcggcucagcguccuuaagucgagaaaguauacauaaauuucuuauauagaauaguagauacucucggcaagguauaaacc

SEQ ID NO: 143 - RNA, 130 nt, Artificial Sequence
  Description of Artificial Sequence: Synthetic polynucleotide
  CasM.295105 guide nucleic acid
uuucgggcggcucggcguccguaaaccgagaaaguauauguaagucugaauuuauucagcguuagauacacucgguaagguucaaacaauacauauucaauccauguauucaguauauuuguacauuuuu

SEQ ID NO: 144 - RNA, 87 nt, Artificial Sequence
  Description of Artificial Sequence: Synthetic oligonucleotide
  CasM.295105 guide nucleic acid
uuucgggcggcucggcguccguaaaccgagaaaguauauguaagucugaauuuauucagcguuagauacacucgguaagguucaaac

SEQ ID NO: 145 - RNA, 134 nt, Artificial Sequence
  Description of Artificial Sequence: Synthetic polynucleotide
  CasM.295187 guide nucleic acid
auauuaagggcggcucagcguccuuaagucgagaaaguauacauaaauuucuuauauagaauaguagauacucucggcaagguauaaacccuacaaauuuaauccuuguaggcaacuuauauuuguauuuauuu

SEQ ID NO: 146 - RNA, 89 nt, Artificial Sequence
  Description of Artificial Sequence: Synthetic oligonucleotide
  CasM.295187 guide nucleic acid
auauuaagggcggcucagcguccuuaagucgagaaaguauacauaaauuucuuauauagaauaguagauacucucggcaagguauaaac

SEQ ID NO: 147 - RNA, 133 nt, Artificial Sequence
  Description of Artificial Sequence: Synthetic polynucleotide
  CasM.295929 guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuu

SEQ ID NO: 148 - RNA, 90 nt, Artificial Sequence
  Description of Artificial Sequence: Synthetic oligonucleotide
  CasM.295929 guide nucleic acid
aaacaagggcggcucaacguccuagaaucgagaaaguaugcguaagacuuauuuauugagcgguagauacucucgguaagguauaaauuc

SEQ ID NO: 149 - RNA, 98 nt, Artificial Sequence
  Description of Artificial Sequence: Synthetic oligonucleotide
  CasM.19924 guide nucleic acid
uggggcaguugguugcccuuagccugaggcauuuauugcacucgggaaguaccauuucucagaaaugguacauccaacuauuaaauacucguauugcu

SEQ ID NO: 150 - RNA, 99 nt, Artificial Sequence
  Description of Artificial Sequence: Synthetic oligonucleotide
  CasM.274559 guide nucleic acid
auggggcaguugguugcccuuagccugaggcauuuaaugcacucgggaaguaccuuuucucagaaaugguacauccaacuauuaaauacucguauugcu

SEQ ID NO: 151 - RNA, 99 nt, Artificial Sequence
  Description of Artificial Sequence: Synthetic oligonucleotide
  CasM.286251 guide nucleic acid
auggggcaguugguugcccuuagccugaggaauuuaauucacucgggaaguaccuuucucaugaaaugguacauccaacuauuaaauacucguauugcu

SEQ ID NO: 152 - RNA, 99 nt, Artificial Sequence
  Description of Artificial Sequence: Synthetic oligonucleotide
  CasM.290816 guide nucleic acid
auggggcaguuggaugcccuuagccugaggcauuuauugcacucgggaaguaccuuuucucagaaaugguacauccaacuauuaaauacucguauugcu

SEQ ID NO: 153 - DNA, 136 bp, Artificial Sequence
  Description of Artificial Sequence: Synthetic polynucleotide
  CasM.292139 guide nucleic acid
ttattagaaatgaaatattttctaatggggttgttggaaagagcttttactgaaatttgtaaaggtgccctgaacttgagaattgaaaaattactcgaggaaatggtacatccaactattaaatactcgtattgct

SEQ ID NO: 154 - DNA, 3 bp, Artificial Sequence
  Description of Artificial Sequence: Synthetic oligonucleotide
ctt

SEQ ID NO: 155 - DNA, 2 bp, Artificial Sequence
  Description of Artificial Sequence: Synthetic oligonucleotide
cc

SEQ ID NO: 156 - DNA, 3 bp, Artificial Sequence
  Description of Artificial Sequence: Synthetic oligonucleotide
tcg

SEQ ID NO: 157 - DNA, 3 bp, Artificial Sequence
  Description of Artificial Sequence: Synthetic oligonucleotide
gcg

SEQ ID NO: 158 - DNA, 3 bp, Artificial Sequence
  Description of Artificial Sequence: Synthetic oligonucleotide
ttg

SEQ ID NO: 159 - DNA, 3 bp, Artificial Sequence
  Description of Artificial Sequence: Synthetic oligonucleotide
gtg

SEQ ID NO: 160 - DNA, 4 bp, Artificial Sequence
  Description of Artificial Sequence: Synthetic oligonucleotide
atta

SEQ ID NO: 161 - DNA, 4 bp, Artificial Sequence
  Description of Artificial Sequence: Synthetic oligonucleotide
attg

SEQ ID NO: 162 - DNA, 4 bp, Artificial Sequence
  Description of Artificial Sequence: Synthetic oligonucleotide
gtta

SEQ ID NO: 163 - DNA, 4 bp, Artificial Sequence
  Description of Artificial Sequence: Synthetic oligonucleotide
gttg

SEQ ID NO: 164 - DNA, 2 bp, Artificial Sequence
  Description of Artificial Sequence: Synthetic oligonucleotide
tc

SEQ ID NO: 165 - DNA, 4 bp, Artificial Sequence
  Description of Artificial Sequence: Synthetic oligonucleotide
actg

SEQ ID NO: 166 - DNA, 4 bp, Artificial Sequence
  Description of Artificial Sequence: Synthetic oligonucleotide
gctg

SEQ ID NO: 167 - DNA, 3 bp, Artificial Sequence
  Description of Artificial Sequence: Synthetic oligonucleotide
ttc

SEQ ID NO: 168 - DNA, 3 bp, Artificial Sequence
  Description of Artificial Sequence: Synthetic oligonucleotide
ttt

SEQ ID NO: 169 - protein, 2 aa, Artificial Sequence
  Description of Artificial Sequence: Synthetic peptide
GS

SEQ ID NO: 170 - protein, 5 aa, Artificial Sequence
  Description of Artificial Sequence: Synthetic peptide
  Linker
GSGGS

SEQ ID NO: 171 - protein, 6 aa, Artificial Sequence
  Description of Artificial Sequence: Synthetic peptide
  Linker
GGSGGS

SEQ ID NO: 172 - protein, 4 aa, Artificial Sequence
  Description of Artificial Sequence: Synthetic peptide
  Linker
GGGS

SEQ ID NO: 173 - protein, 4 aa, Artificial Sequence
  Description of Artificial Sequence: Synthetic peptide
  Linker
GGSG

SEQ ID NO: 174 - protein, 5 aa, Artificial Sequence
  Description of Artificial Sequence: Synthetic peptide
  Linker
GGSGG

SEQ ID NO: 175 - protein, 5 aa, Artificial Sequence
  Description of Artificial Sequence: Synthetic peptide
  Linker
GSGSG

SEQ ID NO: 176 - protein, 5 aa, Artificial Sequence
  Description of Artificial Sequence: Synthetic peptide
  Linker
GSGGG

SEQ ID NO: 177 - protein, 5 aa, Artificial Sequence
  Description of Artificial Sequence: Synthetic peptide
  Linker
GGGSG

SEQ ID NO: 178 - protein, 5 aa, Artificial Sequence
  Description of Artificial Sequence: Synthetic peptide
  Linker
GSSSG

SEQ ID NO: 179 - protein, 3 aa, Artificial Sequence
  Description of Artificial Sequence: Synthetic peptide
GGS

SEQ ID NO: 180 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaaguuc

SEQ ID NO: 181 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaaccccggguaagccugucugcu

SEQ ID NO: 182 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaaccgugcuguuuccuccccacg

SEQ ID NO: 183 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacgugccuuaguuucuucaucu

SEQ ID NO: 184 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacgggggcgggggggagaaaaa

SEQ ID NO: 185 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacgcgcccuccgaucuggggug

SEQ ID NO: 186 - DNA, 78 bp, Artificial Sequence
  Description of Artificial Sequence: Synthetic oligonucleotide
  Engineered guide nucleic acid
tggggcagttggttgcccttagcctgaggcatttattgcactcgggaagtaccatttctcagaaatggtacatccaac

SEQ ID NO: 187 - protein, 18 aa, Artificial Sequence
  Description of Artificial Sequence: Synthetic peptide
  NLS Sequence
  MOD_RES (3)..(13): Xaa can be any naturally occurring amino acid
KRXXXXXXXXXXXKKRKR

SEQ ID NO: 188 - protein, 19 aa, Artificial Sequence
  Description of Artificial Sequence: Synthetic peptide
  NLS Sequence
  MOD_RES (3)..(14): Xaa can be any naturally occurring amino acid
KRXXXXXXXXXXXXKKRKR

SEQ ID NO: 189 - protein, 18 aa, Artificial Sequence
  Description of Artificial Sequence: Synthetic peptide
  NLS Sequence
  MOD_RES (3)..(13): Xaa can be any naturally occurring amino acid
  MOD_RES (17)..(17): Xaa can be any naturally occurring amino acid
  MOD_RES (18)..(18): Xaa = Lysine/ Arginine
KRXXXXXXXXXXXKKRXX

SEQ ID NO: 190 - protein, 19 aa, Artificial Sequence
  Description of Artificial Sequence: Synthetic peptide
  NLS Sequence
  MOD_RES (3)..(14): Xaa can be any naturally occurring amino acid
  MOD_RES (18)..(18): Xaa can be any naturally occurring amino acid
  MOD_RES (19)..(19): Xaa = Lysine/ Arginine
KRXXXXXXXXXXXXKKRXX

SEQ ID NO: 191-199 - skipped (9 entries)

SEQ ID NO: 200 - protein, 20 aa, Artificial Sequence
  Description of Artificial Sequence: Synthetic peptide
  Endosomal escape protein
  MOD_RES (4)..(4): Xaa is independently selected from lysine, histidine, and arginine
  MOD_RES (8)..(8): Xaa is independently selected from lysine, histidine, and arginine
  MOD_RES (11)..(11): Xaa is independently selected from lysine, histidine, and arginine
  MOD_RES (15)..(15): Xaa is independently selected from lysine, histidine, and arginine
  MOD_RES (19)..(19): Xaa is independently selected from lysine, histidine, and arginine
GLFXALLXLLXSLWXLLLXA

SEQ ID NO: 201 - protein, 20 aa, Artificial Sequence
  Description of Artificial Sequence: Synthetic peptide
  Endosomal escape protein
GLFHALLHLLHSLWHLLLHA

SEQ ID NO: 202 - protein, 483 aa, Artificial Sequence
  Description of Artificial Sequence: Synthetic polypeptide
  CasM.19498
LHETEKSLKFAEKYIAMPTITRKIELTLCTEGLSDEQRKEQWGLLYHINDNLYKAANNISSKLYLDEHVSSMVRMKHAEYLSLQKELARAEKQKVDDAIIVELTRKLAVAEKEMTDQELAICKYATEMSTNTLAYNFAKEIETKIFGQILACLENNAHALFVDDSPNVRRGERAIRNYKKGMPIPFPWNRSIKIEADGGEFYLRWYNGLRFLLTFGKDRSNNRLIVKRCMKMDEVFEGEYKLCNSSIQLAKRDGKPKLFLLLVVNIPQEHVELNKNIVVGVDLGVNVPAYVATNITEERKAIGDREHFLNTRMTFQKRYKSLQRLKGTAGGKGRTKKLEPLERLRDAERNWVHTQNHLFSREVVNFAVQARAATINIEDLSGFGKDNDGNADEKKEFVLRNWSYYELQNMITYKASKYGIKVEKIRPDYTSKTCSWCGQQGFREGVTFICENPECKQHGEKIHADYNAARNIANSKDIIKKNE

SEQ ID NO: 203 - protein, 467 aa, Artificial Sequence
  Description of Artificial Sequence: Synthetic polypeptide
  CasM.19548
MAETKRLQKVAKFQIVKPVNMSWDELGRMLRDVRYRLSRLANMAVSETYQNLHQRYRLKNQDAPKSLKIGQLSRNLRKILREEGVEEENLSKYSKTCVLPDTITGAFSRYKLSSIDWRKVLTGKISVPNYKTNLSIPIRCDKPHQRRLELTETGEIEADLMICNKPYPRVLLSTRTISDGQRTVLERLVSNKTNFLPGYRHRFFEVKEKKGKWELSVTYDFPKAEATRLHPDIIVGVDLGWSVPLYAAINNGYARIGYRKFEPLAKRIKHLQKQIKGRRFSTQKGGVKDLAQPTARAGHGRKRILKPIEKLEYKIDNAYTTLNHQLSHCVVEFAKNNGAGLIQIENLEGLKDDLSGTFIGQNWRYNQLQNFIKYKADEAGIKVHPVNPCYTSRRCSHCGFIHISFDREYRDKNRKNGKATMFECPKGCKPLNADYNAAKNLATFDIEEKIRLQCKQQSIEYKELPKD

SEQ ID NO: 204 - protein, 472 aa, Artificial Sequence
  Description of Artificial Sequence: Synthetic polypeptide
  CasM.19910
MPGTEKRLQKVATFEIVKPVNMSWPEFGKMLRDVRYRYWRLANMAVCENYMRFYQWRTQQTDANDRYKVKTLNRILRKMLIEEKNADEKELSRYSRDGAVSGYICGAFEKTKLSAVKSSSKWKKVIAGKESLPLFKKDLAIPINCSDHQPRLIERTQSGEYEVDLRICQQPYPRVLLSTAKISDGQKAILERLVSNETNSLPGYRHRFFEIKEKRNKWYLSVSYDFPKIDATRLHPNIIVGVDLGWSVPLYAAISNGYARIGYRKLKALGDRIKALQRQTIARRRSIQRTGEQDLSAPTARSGHGRKRILHPIEKLEGKIDNAYKTLNHQLSHCVIEFAKNHGAGLIQVENLKGLAEELSGTFIGQNWRYNQLQEFIKYKAKEAGIEVKEVNPCYTSRRCSECGFIHKEFTFEYRQANKKTDKATMFECPKCGYKAIADYNAARNLANPDIAEKIRLQCKEQGIEYKELPKD

SEQ ID NO: 205 - protein, 468 aa, Artificial Sequence
  Description of Artificial Sequence: Synthetic polypeptide
  CasM.19948
MPTITRKIELHFCTEGLSDEKQKEQRQLLYHINDNLYKAANNISSKLYLDEHVSSMVRLKHADYLSLQRELARAEKQKTPDDELITELSRKLSAAEKEMTDQELAICKYATEMATSTLAYNFAKEMETEIFGQILACLENNAHAVFVDDSLSVKRGERAIRNYKKGMPIPFPWNKNIKIETKDCEFYLRWYNGIRFRLHFGKDRSNNRLIVQRCLKLDDNFESEYKLCNSSIQLDKRDGKTKLFLLLVVNIPQEHVELNKNIVVGVDLGLNYPAYVATNSTEERKYIGDRDHFLKIRMQFQSRYKSLQRLKGTAGGKGRAKKLEPLERLRKAERNWVHTQNHLFSRDVVNFAVQTHAATIHMEDLSGFGKDNDGNADEKKEFVLRNWSYYELQSMIEYKAAKYGIKVEKIRPAYTSKTCSWCGQQGDRKSTTFICENPECKHYGESIHADYNAARNIANSKDIVKKNE

SEQ ID NO: 206 - protein, 453 aa, Artificial Sequence
  Description of Artificial Sequence: Synthetic polypeptide
  CasM.265291
MSKITRKIEIIPDIDGITHEESNKKCYNTFYKFDRKLYKVANLLVSQLYGLDNLLSLMRLQNDEYVKCQSKLSFKSITDATKEEIKKRMQEIDAELVSMKNDIAPKHPQTYSYRAVTSSEYAKDIPSDILNNLKQDVYQHFNENKKEQIRGERSLATYKKGMPIPFSFEKRHVIICDGDNYYLPWFEDTRFRLNFGRDRSNNRAIIDNCIKTKKYKLCAAAKIQLKERKLFLLITVDIPKAESVPVKGKVMGVDLGVINPAYVAVNDGPERSRIGNGEAFQKQRDVFRRRFRELQRSQLTQGGHGRKHKTKATEILRGKERNWVQTENHRISREIVNLASRWKVETIQMESLKGFGKNQEGEVEYNHKRLLGRWSYFELQKDIEYKAAMAGIAVQYVNPAYTSQTCHVCGQRGNRIERDTFICTNPECTCYNQAQDADMNAAINIAKSKDVIK

SEQ ID NO: 207 - protein, 468 aa, Artificial Sequence
  Description of Artificial Sequence: Synthetic polypeptide
  CasM.270012
MPTITRKIELTLCTDGLSDEERKAQWGLLYHINDNLYKAANNISSKLYLDEHVSSMVRLKHAEYLSLQKELAKAERQKMPDVDVIEELRERLSAAEQEMSDQELAICKYATEMSTNTLAYRFATEIETNIFGQILARLENNAQAVFLTDAPDVKRGERAIRNYKKGMPIPFPWNNSIKIECEGGEFYLRWYSGLRFHFNFGKDRSGNRLIVQRCLKLDKEYDGEYKLCNSSIQMVKRDGSTKFFLLMVVNIPQEYVELNKHIVVGVDLGINVPAYVATNITPERKAIGDREHFLNTRMAFQRRYKSLQRLKTTAGGKGRTKKLEPLERLRQAEHNWVHTQNHLFSREVVNFALQTHAATIHLEDLSGFGKDSDGNADERKEFVLRNWSYYELQNMITYKAAKYGIRVEKIRPAFTSRTCSCCGHEGFREGVTFICENPECQQFGEKVHADYNAARNIANSKDIIKKNE

SEQ ID NO: 208 - protein, 468 aa, Artificial Sequence
  Description of Artificial Sequence: Synthetic polypeptide
  CasM.272451
MPTITRKIELTLCTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTETLAYKFATEIETNVFGQILACLKQAAQSNFKNDAKDVKRGERAIRNYKKGMPIPFPWNDSLRIEKDNKDFYLRWYNGLRFLFNFGKDRSNNRLIVERCLKMDADYDGEYKLCNSSIQIAKREGKVKLFLLLVVSIPQEHVELNKKVVVGVDLGINVPAYVATNITEERKAIGDREHFLNTRMAFQRRYKSLQRLKGTAGGKGRTKKLEPLERLRKAEHNWVHTQNHLFSREVVDFAVKTHAATIHMEDLSGFGKDNDGNADERKEFVLRNWSFYELQNMITYKAAKYGIKVEKIRPAYTSKTCSCCGRQGFRSGVTFICENPECKQYGEKVHADYNAARNIANSKEIIKKNE

SEQ ID NO: 209 - protein, 480 aa, Artificial Sequence
  Description of Artificial Sequence: Synthetic polypeptide
  CasM.274429
MKNNVEEKRPDKEKRLTKVATFQIVKPVNMSWSEFGKMLRDVRYRLSRLANMAVSEAYQNLHQRYRLKNQNAPKSVKIGQISRDLRKILLEEGLEEENLSKYSKMCVLPDTITGAFSRYKLSTIDWRKVLTGKISIPNYKANLSIPIRCDKPQQRRLERTETGEIEVDLMICNKPYPRVLLSTRTISDGQRSVLERLVLNNANSLPGYRHRIFEIKEKRNEWYLSVTYDFPKAETTKLHSDIIVGVDLGWSVPLYAAINNGYARIGYKQLKPLGDSIKALQRQTIARRRSIQRGGTQDLAAPTARSGHGIKRILQPIEKLEGKIDNAYKTLNHQLSHCVIEFAKNHGAGVIQIENLKGLAEELSGTFIGQNWRYYQLQEFIKYKAKEAGIIVKEVNPFYTSRRCSECGYIHKDFTFEYRQANRKNGKSTMFECPKKEEKGCKPLNADYNAARNLATSDIEDKIRLQCKEQGIEYKEIKEK

SEQ ID NO: 210 - protein, 442 aa, Artificial Sequence
  Description of Artificial Sequence: Synthetic polypeptide
  CasM.277378
VTLLVKVVKIHLISEQFDKAGNRIDYKEVNKILWELQKQTREAKNKTVQLLWEWNNFSSDYVKASGIYPKAKDIFGYSSVHGQANKELRTKLILNSSNLSTTTMDVCKIFNTYKKEVWEGKRSVPSYKSDQPLDLHNDSIKLIYENKEFYVRLGLLNRAGFAKYGFKDGFRFKMQVKDNSTKTILERCFDGIYTIVASKLLYDQKKNRWKLNLSYSFDNKNISELDKEKILGVDVGVSCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKADRFLKDWTYYDLQTKIENKAKEVGINVVYIAPKYTSQRCSKCGYIHKDNRPNQAKFRCLKCDFESNADYNASQNIGIKNIDKTIKKERKKQKSEAQVNEK

SEQ ID NO: 211 - protein, 492 aa, Artificial Sequence
  Description of Artificial Sequence: Synthetic polypeptide
  CasM.280852
MAGKKKDKDVINKTLSVRIIRPRYSDDIEKEISDEKAKRKQDGKTGELDRAFFSELKSRNPDIITNDELFPLFTEIQKNLTEIYNKSISLLYMKLIVEEEGGSTASALSAGPYKECKARFNSYISLGLRQKIQSNFRRKELKGFQVSLPTAKSDRFPIPFCHQVENGKGGFKVYETGDDFIFEVPLIKYTATNKKSTSGKNYTKVQLNNPPVPMNVPLLLSTMRRRQTKKGMQWNKDEGTNAELRRVMSGEYKVSYAEIIRRTRFGKHDDWFVNFSIKFKNKTDELNQNVRGGIDIGVSNPLVCAVTNGLDRYIVANNDIMAFNERAMARRRTLLRKNRFKRSGHGAKNKLEPITVLTEKNERFRKSILQRWAREVAEFFKRTSASVVNMEDLSGITEREDFFSTKLRTTWNYRLMQTTIENKLKEYGIAVNYISPKYTSQTCHSCGKRNDYFTFSYRSENNYPPFECKECNKVKCNADFNAAKNIALKVVL

SEQ ID NO: 212 - protein, 487 aa, Artificial Sequence
  Description of Artificial Sequence: Synthetic polypeptide
  CasM.281050
MPDTDKGKRLTKVATFQIVKPVNMSWNEFGKMLHDVRYRYWRLANMAVCENYMRFYRWRTQQTDTNDHYKVKIINGILRKMLIEEKNADEKELSRYSRDGAVSGYVYGAFTQTKLSAITSKSKWGEVIKGKSALPLFKRDTSIPIMCTDKKPSMIEKTASGEYEVDLRICLKDKQLRPNGYPSVLLSTTKISDGQKAVLERLVSNKTNSLPGYRHRFFEVKEKRGDWYLSVSYDFPQAEATRLHPDIIVGVDLGWSVPLYAAINNGYARIGWRKLEPLAKSIKHLQKQTIVRRRSFQKGGKKDLAASTARTGHGIKRILQPIEKLEGKIDNAYKTLNHQLSHCIIEFAKNHGAGVIQIENLKGLAEELSGTFIGQNWRYHQLQEFIKYKAEEAGIAVKEVNPRYTSRRCSKCGYIHIGFDREYRDKNRKNGKSTMFECPECSKRIKDYKPLNADYNAAKNLATADIEEKIRLQCKEQGIEYKELPKD

SEQ ID NO: 213 - protein, 471 aa, Artificial Sequence
  Description of Artificial Sequence: Synthetic polypeptide
  CasM.285333
MPTITRKIKLELCTKGLSEEERKAQWNLLYHINDNLYRSANNISSKLYLDEHVSSLVWLKHKEHQTLKADLAKAKKQKIQDEKTIAELESRLKSCESEMSDQELAICKYTDEMSSKTLSYKFATELELNIYAQILTQVQSKVYADFQNDQKDVRDGKRAIRTYKKGMPIPFPWRNNIRMEPVKKGREYEFYIKWYNDIRFQLIFGKDRSNNRLILQRCFKLDENCVEDYQMRTSSIKMVKGANGTELFLYLVVDIPQEKHILNNKIVVGVDLGINVPAYVATNVTDDRKAIGDREHFLNTRMAISKRFHSFQRLKGTTGGRGKTKKLEPLERLKEKERNWVHTQNHLFSRDVITFALHVKAATIQMEDLSGYGKDDEGNVVEEKKFLLGKWSYYELQEMIKYKAKKVGMRVNFIKPAYSSQTCSWCGERGERNSTSFVCTNSECSHYGEDLHADYNAARNIARSKNIIRYE

SEQ ID NO: 214 - protein, 377 aa, Artificial Sequence
  Description of Artificial Sequence: Synthetic polypeptide
  CasM.286285
MIITRKIQILFAAQGEEFKKDKDTLYKWSNIVHHASNIVASNKYVCDHLQGMVYLTEEGKEAVSELSQKVDDIFNTSRMNTTYRMISSLYKGEIPTDILSCVNMQVSKLYNKERKKMADGDRSLRSYRSNIPIPFSANSLMRKWKYADKEYSFDLFGIPFKVVLGKDKSNNRSILERLMDGTYKAATSSIKIQNCEDETGKKTRKFFLLLCVEIPDKSYAGREDNILFAELSIDHPLLVSFPIKKEESKPIPIGNKQSYLYKRLQIQKGLDSCKASCKWNKGGRGRKRKMKSTERFKAKEHNFVDAYMHQISAALIKFAIKHDIGKLCLVDVDKKIKEAKESPFVLRNWSYYSLLTKIQYKAKMNGITVVMVDKNVL

SEQ ID NO: 215 - protein, 483 aa, Artificial Sequence
  Description of Artificial Sequence: Synthetic polypeptide
  CasM.286678
MPTITRKIRLHLCTDGLSEEERKAQWKMLYRINDNLYRAANNISSKLYLDEHISSMVRLKHAEYTSLKTELLKAKKADDEETVAELEARINVLNAELSAQEEAICSYATEMATRTLAGKFASELDLNIYGQILAEVKSVVFKNFNSDSKDVREGKRSIRTYKKGMPIPFPWNKTIRLEAVKKESSSKHDEDEYEVYLNWYKSSRTEKKAIRFRLDFGKDKSNNQQIVKRCLNLDNTSSESYQLQTSSIQMKKGSEGAELYLLLVVNIPQDQHVLNKKIVVGVDLGINVPAYVATNCTEERKSIGDREHFLNARIAFHRRFHSFQKLKGTTGGRGRKKKLEPLERLREKERNWVHTQNHLISRDVINFALQTKAATIQMEDLSGYGKDEEGNVKPENKFLQSRWSYFELQSMIKYKAAKCGIKVNLINPSYTSQTCSWCGQMGVRESTSFVCQNPECKKYGKDIHADYNAARNIARSNKTVKNE

SEQ ID NO: 216 - protein, 478 aa, Artificial Sequence
  Description of Artificial Sequence: Synthetic polypeptide
  CasM.287128
MPTITRKIELRLCTEGLSDEERKAQWMLLYHINDNLYRSANNISSKLYLDEHVSSMVRLKHAEYQSTAAELLKAKKNNADEGTISTLEDKVETLKTEMSAQGIAICNYATEMATRTLAGKFASELELNIYGQILAEVKNVVHTNFTNDAKEVREGKRSIRTYKKGMPIPFPWNKSIKIEPVKASSQNEGQDDYEFYLKWYNGLKFILHFGKDRSNNRQILKRCFGLDNLCNERYQMRTSSIQMKKGSNGMELYLLLVLSIPKEQHSLNKKVVVGVDLGINVPAYVATNCTEERRAIGDREQFLNTRMAIIRRKHSFQRLKGTAGGRGRKKKLDPLERLRETERNWVHTQNHLYSRDIIKFALETKAATIQMEKLKGFGRDDNGNVIEEKKFLLGKWSYYELQNMIKYKAGKVGIKVNFIAPAYTSQTCSCCGVRDDRNRKSTSFICHNPDCQMYGKEIHADYNAARNIARSKNVIKDE

SEQ ID NO: 217 - protein, 468 aa, Artificial Sequence
  Description of Artificial Sequence: Synthetic polypeptide
  CasM.287826
MPAITRKIELTLCTEGLSEEQRKEQWGLLYHINDNLYKAANNISSKLYLDEHVSSMVRMKHADYLSLLKELARAEKQKTPDDELIAELREKLSLAEQEMTDQELAICNYATEMATSTLAYNFAKEIETEIFGQILACLENNAHAVFVDDSPTVRRGERAIRNYKKGMPIPFPWNKSIRIVEKDGEFYLRWYNGMRFLLTFGKDRSNNRIIMKRCLKMDQDFEGEYKLCNSSIQMVKREGKTKLFLLIVVNIPQEHVELNKNIVVGVDLGVNVPAYVATNITEERKAIGDREHFLNTRMQFQRRYKSLQRLKGTAGGKGRTKKLEPLERLRKAEHNWVHTQNHLFSREVVNFAVQTRAATIHMEDLSGFGKDNDGNADEQKEFVLRNWSFYELQNMIAYKAAKYGIKVEKVKPAYTSKTCSWCGQLGFRQGVTFICENPACKQCGEKVHADYNAARNIANSKDIIKKNE

SEQ ID NO: 218 - protein, 478 aa, Artificial Sequence
  Description of Artificial Sequence: Synthetic polypeptide
  CasM.287896
MAGQRHTKVAKFQILKPAADMRWSELGRLLRDAQYRVYRLANLALSEKYLRFHLFRTGQTESLPECRIGRLNRQLRQMLKDEGGADDSVLDRFSRTGALPDTVVGALWQYRLHALTKGEKWNKVTRGETALPTFRRSMALPIRCDKRIHHRLERAALDSVELDLMICTRPYPRVILKTAKLDDGAAAILERLLDNEGQLLEGYRQRCFEVRYAEDEKAWWLHVTYDSPATPAPHLSKDIIVGVDLGFSCPMYVALSNGDARLGRRQFAALAARIRSLQTQVMARRRQMLSGGKASLSGDTARSGHGRKRKLLPIESLEGRINRAYTTLNHQLSISVVHFAVHHGAGVIQIENLEGLQNELTGTFLGQRWRYHQLQEFLNYKANEAGIEVRRVNPRYTSRRCSKCGYIHVDFNRAFRDAARQEGKVARFCCPKCEYEAHPDYNAARNLATVDIEGIIKVQCERQGIDRPSVENQDEVAK

SEQ ID NO: 219 - protein, 469 aa, Artificial Sequence
  Description of Artificial Sequence: Synthetic polypeptide
  CasM.287936
MPTITRKIELTLCTEGLSDQERKDQWNLLYHINDNLYRAANNISSKLYLDDHVGSMVRLKHAEYLSLLRALEKAKKQKAPDEEVIAELSQQVATAEQEMDEQAKAICQYATEMSTQTLSYRFATELETNIFGQILTCLRQGVFSTFNSDARDVKRGERSIRTYKKGMPIPFPWNDSLRIGFEDGEFYLRWYNGLRFRFDFGKDRSNNRLIVQRCMKMDKDYEGDYKLCNSSIQMVKREGKPKFFLLLVVNIPQERVELNKNIVVGVDLGINAPAYVATNTTPERKQIGDREHFLNERMAFQRRFKSLQRLKSTTGGRGRAKKLEPLERLRKAEQNWVHTQNHLFSREVIDFAVKARAATIHMEDLSGFGKDRDGNADERKEFVLRNWSYYELQNMITYKAAKYGIKVEKIRPAYTSKTCSWCGHQGFREGITFICENPECKKFGEKEHADYNAARNIANSKEIIKNNEE

SEQ ID NO: 220 - protein, 469 aa, Artificial Sequence
  Description of Artificial Sequence: Synthetic polypeptide
  CasM.288450
MPTITRKIELSLCTDGLSDEQLKEQRQLLYHINDNLYRAANNVSSKLYLDEHVSSMVRLKHADYLSLLRDLARAEKQKSPDEALISELRSKLAAAQREMTEQELAICRYATEMSTQSLSYRFVTEMETHIFAKILDCLKQGVYATFNSDARDVKRGERSIRNYKKGMPIPFAWSDSVRIEQEADEFYLRWYNGIRFRLVFGKDRSNNRLIVKRCLKLDKDYEGDYKLCNSSVQMVKREGKPKTFLLLVVKIPQEQVELNKKIVLGVDLGINYPVYAATNCTEERIYFGEREHFLNTRMQFQRRYKSLQRLKGTTGGKGRKKKLEPLERLRKAERNWVHTQNHLFSQKTVDFALQTHAATIHLEDLSGFGRDSDGSAEEKKEFVLRNWSYYELQQMITYKAAKYGIKVEKIRPAYTSQTCSWCGQRGFRQGVTFICENPECKKCGEKEQADYNAARNIAKSKDVIKDDDE

SEQ ID NO: 221 - protein, 453 aa, Artificial Sequence
  Description of Artificial Sequence: Synthetic polypeptide
  CasM.288712
MSIVTRKIELIPDIENLTHEESNQRCYKLLYNIDKKLYKLANLLVCQLFGLDNLLSLMRLQNDEYVKFQSKLASKSISKETQKNIKEHMKEIDKELLARKAEIAPKSPLTFAYRAIKGSLYAKDLPSDIFNTLKQDVFKHFNETKKEQLRGERSLATYKRGIPIPFSLMKKNVIVSEGDNYYLTWFEETRFKLNFGKDRSNNRAIIDNCLKTNKYKLCTAAKIQLKNKKLFFLVTVDIPETKNTIIKGKVMGVDLGVVHPAYVAVNDGPERSLIGDGDAFQKQRDVFRRRFKELQRCQLTQGGHGRKHKTKATEILRGKERNWVQTENHRISRKIVNLAIRWKVESIQMENLKGFGKDSEGEVETKHKRLLGRWSYFELQKDIEYKAQKAGIKVVYINPAYTSQTCHVCGKKGDRTERDTFICLNTECSCYGKPQDADMNAAINIARSKNIVK

SEQ ID NO: 222 - protein, 468 aa, Artificial Sequence
  Description of Artificial Sequence: Synthetic polypeptide
  CasM.289248
MPTITRKIELMLCSEGLSDEQRKEQWGLLYHINDNLYKAANNISSKLYLDEHVSSMVRMKHAEYLSLLKELARAEKQQTPDEGLIAELSRKLSAAEKEMADQELAICKYATEMSTQTLSYNFAKEIETNIFGQILTCLRQGVYATFNSDAKDVKRGERAIRNYKKGMPIPFPWNKSLKIEAEGGDFYLRWYNGLRFLLTFGKDRSNNRMIVKRCMKMDEDFEGEYKLCNSSIQLAKRDGKPKLFLLLVVNIPQEHVELNKKIVVGVDLGVNVPAYVATNITEERKAIGDREHFLNTRMAFQRRYKSLQRLKGTAGGKGRTKKLEPLERLRDAERNWVHTQNHLFSREVVNFAVQARAATIHMEDMSGFGKDKDGNADEKKEFVLRNWSFYELQNMIAYKSAKYGIKVVKIRPAYTSKTCSWCGQQGERKSTTFICENPECKHYGESIHADYNAARNIANSNDIVKENE

SEQ ID NO: 223 - protein, 385 aa, Artificial Sequence
  Description of Artificial Sequence: Synthetic polypeptide
  CasM.289726
MVITRKIEVFVCESDNDLRRSYYEKLYDIRNIAQEAANRATSMLYAIDNLIPCLDEDSRKLIQYIGAKGTPASRQNAAYTIMSHLYKDRMPGIMDMLSNLAQYVTKNYSEDRKRGMYKNALRSYKCSLPVPYQKKSFKGLRFNWYEDSDGDAHEGCFFSLAGVPLQMRFGRDRSNNRLIVERVISGEYKMCTSSLKFDGKKLFLLLCVDIPKQEANVDPKKTLYAYLGVMNPIICTCDVRAKQEYDSGYKCFEIGTKEEFNYRRRQIQEAVRRCQINNRYSSGGKGRKKKCQAIERWHEKEKNYVDTKLHTYSRMLVDLAVAHKCGTIVLLNQKKREDKAKDDNQNGEPFVLRNWSYYNLKDKIGYKCKLAGIKLVQDKEETEEE

SEQ ID NO: 224 - protein, 372 aa, Artificial Sequence
  Description of Artificial Sequence: Synthetic polypeptide
  CasM.289802
MVITRKIEVFVCEDSKDLRKEYYDKIYKCRDIAVKTANLGVSHLFMLDNTTPYLSDDDREKLTFLGCSGKKATKQNAPYVAASEKFKGQADMSMLSSVLQNVGKMYQDDKKKGMWSKSLRSYKANMPIPFKASCYRNLRFADYNDKEDKPHNGCFFTLMGIPFQCKFGKDRSGNRIIMQAVVDGKYKMCTSSLQIDGKKIFLLLCVDIPKKVVKLDESKTLYAFLGVMNPIVCTTDIKQKGDIDTDWKLWEIGTEAEFNYRRRQIQEAVKRCQVNNRYSRGGHGRFAKTKAIERWRAVERNYVDTKLHTYSKMLIDLAVKHKCGKIVLMNQLHREDAAKDDKFVLRNWSYHSLRTKIDYKAKMYGIKVEVEK

SEQ ID NO: 225 - protein, 483 aa, Artificial Sequence
  Description of Artificial Sequence: Synthetic polypeptide
  CasM.290380
MPVITRKIKLNLCTEGLSEDERKAQWKMLYRINDNLYRAANNISSKLYLDEHVSSMVRLKNAEYTSLVSDLMKAKKAEDEAAITDLEAKIESLKSEMTAQEEAICCYATEMATRTLAGKFASELDLDIYGQILAEVKSVVFKNFNSDSKEVREGNRSIRTYKKGMPIPFPWNKTIRLEAVKKELSGKHDEDEYDFYLNWYKSSRTDKKAIRFRLYFGKDKSNNQQIVKRCLHLDSTSSENYQMQTSSIQMKKGPEGAELYLLLVVNIPQEQHALNKKIVVGVDLGINVPAYVATNCTEERKAIGDRDHFLNTRMAFSRRFHSFQRLKGTSGGKGRKKKLEPLERLREKERNWVHTQNHLISRDVINFALQVKAATIQMEDLSGYGKDEEGNVKPENKFLQSKWSYFELQSMIKYKAAKCGIKVNLIAPAYTSQTCSWCGQMGIRESTSFVCQNPECKQYGKDIHADYNAARNIARSNKIVKNE

SEQ ID NO: 226 - protein, 477 aa, Artificial Sequence
  Description of Artificial Sequence: Synthetic polypeptide
  CasM.292901
MRISKTLSLRIVRPFYTPEVEAGIKAEKDKREAQGQTRSLDAKFFNELKKKHSEIILSSEFYSLLSEVQRQLTSIYNHAMSNLYHKIIVEGEKTSTSKALSNIGYDECKAIFPSYMALGLRQKIQSNFRRRDLKNFRMAVPTAKSDKFPIPIYRQVDGSKGGFKISENDGKDFIVELPLVDYVAEEVKTAKGRFTKINISKPPKIKNIPVILSTLRRRQSGQWFSDDGTNAEIRRVISGEYKVSWIEIVRRTRFGKHDDWFVNMVIKYDKPEEGLDSKVVGGIDVGVSSPLVCALNNSLDRYFVKSSDIIAFNKRAMARRRTLLRQNKYKRSGHGSKNKLEPITVLTEKNERFKKSIMQRWAKEVAEFFRGKGASVVRMEELSGLKEKDNFFSSYLRMYWNYGQLQQIIENKLKEYGIKVNYVSPKDTSKKCHSCTHINEFFTFEYRQKNNFPLFKCEKCGVECSADYNAAKNMAIA

SEQ ID NO: 227 - protein, 478 aa, Artificial Sequence
  Description of Artificial Sequence: Synthetic polypeptide
  CasM.293203
MEEKTKRLQKVAKFQIVKPVNMTWVELGKMLRDVRYRLWRLANMAVCENYMRFYQWRIGKTDANENHKVKILNRRLREMIIEEKQADAKELMRYSRDGVVSGYICGAFEKIHLSAIKNKSKWREVIRGKSNLPLFKRDLPIPINCSDHKPSLIAKTESDEYEVDLRICQKPYPRVLLSTAKISGGERAILERLVSNKTNSLPGYRHRFFEIKEKPKGRWNLHVTYDFARSEATMLHSDIIVGVDLGWSVPLYAAVNKGHARIGWRKLEPLAKRIRHLQKQVKARRLSVQKGGQRDLAAPTARAGHGRKRILQPIEKLEGKIDDAYKTLNHQLSHCVIEFAKNNGAGVIQVENLEGLKDTLTGTFIGQNWRYNQLQNYIEYKAKEAGMELKKVNPCQTSQRCSNCGFIHRDFTFEYRQANKKNGKAAMFECPECSKKENYKPLNADYNAARNLATAGIEGKIRLQCEKQGIEYKGLPEE

SEQ ID NO: 228 - protein, 453 aa, Artificial Sequence
  Description of Artificial Sequence: Synthetic polypeptide
  CasM.294190
MSKITRKIEIIPDIEGLTHDESNKKCYGAFYTFDKNLYKVANLLVSQLYGLDNLLSLMRLQNDEYVKCQSKLSLKSTTDAEKENLKKRMKKIDAELVSIKNGMAPKHPQTFAYRAVTNCVYAKNIPSDILNTLKQDVYKHFNDTKKEQFLGERSLTTYKRGMPVPFSIEKKHAIVCDGDNYYLPWFEDTRFRLNFGRDKSNNRAIIDNCIKTKRYKLCAAAKIQLKDKKLFLLVTVDIPATETTSVKGKVMGVDLGVVNPAYVAVNDGPERSRIGNGEAFQKQRDVFRRRFRELQRSQLTQGGHGRKHKTKATETLRGKERNWVQTENHRISREIVNLASRWKVECIQMESLKGYGKNQEGEVEDNHKRLLGRWSYFELQKDIEYKAAMVGIQVKYINPAYTSQTCHVCGQRGNRIERDTFICTNPECTCYNQAQDADMNAAINIAKSKDVVK

SEQ ID NO: 229 - protein, 469 aa, Artificial Sequence
  Description of Artificial Sequence: Synthetic polypeptide
  CasM.294406
MPTITRKIEMKLCTEGLSDQERKDQWNLLYHINDNLYRAANNISSKLYLDDHVLSMVRLKHAEYLGLLRALEKAKKQKIPDEEVIAELSQKVAAAEQEMDDQAKAICQYATEMSTQSLSYRFATELETGIFTKILDCLKQGVFATFNSDTRDVKRGERSIRTYKKGMPIPFAWNDSLRIELEDGEFYLRWYNGLRFRFDFGKDRSNNRLIVRRCLNMDEDYEGDYKLCNSSIQMVKREGLAKFFLLMVVNIPQEQVELNKKIVVGVDLGINAPAYVATNITSERKQIGDREHFLNERMAFQRRFKSLQRLKGTTGGRGRAKKLEPLERLRKAEQNWVHTQNHLFSREVIDFAVKSRAATIHMEDLSGFGKDRDGNADDKKEFVLRNWSYYELQSMITYKAAKYGIKVEKIRPAYTSKTCSWCGHQGFREGITFICENPECKKYGEKEHADYNAARNIANSIEIVKNNEE

SEQ ID NO: 230 - protein, 478 aa, Artificial Sequence
  Description of Artificial Sequence: Synthetic polypeptide
  CasM.294601
MKDYIRKTLSLRILRPYYGEEIEKEIAAAKKKSQAEGGDGALDNKFWDRLKAEHPEIISSREFYDLLDAIQRETTLYYNRAISKLYHSLIVEREQVSTAKALSAGPYHEFREKFNAYISLGLREKIQSNFRRKELARYQVALPTAKSDTFPIPIYKGFDKNGKGGFKVREIENGDFVIDLPLMAYHRVGGKAGREYIELDRPPAVLNVPVILSTSRRRANKTWFRDEGTDAEIRRVMAGEYKVSWVEILQRKRFGKPYGGWYVNFTIKYQPRDYGLDPKVKGGIDIGLSSPLVCAVTNSLARLTIRDNDLVAFNRKAMARRRTLLRQNRYKRSGHGSANKLKPIEALTEKNELYRKAIMRRWAREAADFFRQHRAATVNMEDLTGIKDREDYFSQMLRCYWNYSQLQTMLENKLKEYGIAVKYIEPKDTSKTCHSCGHVNEYFDFNYRSAHKFPMFKCEKCGVECGADYNAARNIAQA

SEQ ID NO: 231 - protein, 480 aa, Artificial Sequence
  Description of Artificial Sequence: Synthetic polypeptide
  CasM.294655
MPFKVLKLKIIKPVNMDWNELGQSIRDTRYRVYRLANLAVSEAYLAFHLWRAGKTDAIPKATAGQLNRRLRDMLLEEARTKAVKDRKNTGEKGTEDDAKKAQKEMNKFSKTGALPDTVAGALFMYKVKGLISKGKWTQVIRGKSALPTFRNNMAIPIRCDKKTQRRLERTENGVELELMIRNKPYPRVLLGTQGIGEGAEAIIERLLSNESQAEQGYKQRYFEVREDVNRTWWLYVCYALPASTPPRLDPSKIVGVDLGFTCPMYAAISNGHARLGYRAFSSLAARVKALKLRTMRRRREIQRGGRTIVSGEAARSGHGRKRKLLGIEKLQGRVNQAYTTLNHQMSAAVVKFAIENGAGTIQVENLEGLREELSGTFLGQMWRYFQLQEFLQYKAEENGIVIRKVNPRYTSRRCSQCGHINKEFTRKARDRNAEGGYSAKFKCPDCEYEADADYNAAKNLAVDGIEGIIEKQCGSQGIVL

SEQ ID NO: 232 - protein, 494 aa, Artificial Sequence
  Description of Artificial Sequence: Synthetic polypeptide
  CasM.295201
MFLYKELKTMAKTNAEEGKIENKEKRLTKVAKFQIVKPVNMTWPEFGKMLGDVRYRLSRVANMAVTEKYLESQQKRTGQKIQRENTLVTIANRKLREMLKKEKVKEEELDRYSRDGAVSGYVTGPFEHNKLSAISKRFKEVLKGNMSLPNFKREMAIPINCSNAKLSTIEKTETGEYVVDLRISQKPWPRVLLSTNRISNGQREILERLAANKTFSDDGYKHLFFEVKQQGKDWFLSVTYSFPKSEAPKLHKDIIVGVDLGWSVPLYAAVNKGYARIGWQKFRPLAERIKHLQKQVKARRITIQKGGQQDLATPTARTGHGRKRILRPIEKLERKIENAYTTLNHQLSHCVIEFAKNNGAGVIQIENLSGLANELSGTYIGQNWRYEQLQEYIRYKAEEAGIEVKHVNPCRTSQRCSECGFINDKFNFEYRQANRNNGMSAMFECPECKKNKKDYKPINADYNAAKNLTTANIDEIIRLQCKKQGIEYKELPKD

SEQ ID NO: 233 - protein, 453 aa, Artificial Sequence
  Description of Artificial Sequence: Synthetic polypeptide
  CasM.296640
MSKITRKIELIPDIENLTHEESNQRCYKVFYNIDNKLYKVANLLVCQLFGLDNLLSLMRLQNDEYVKCQSKLASKSISEETKRDIKKRMEAIDKELLARKDEIAPKHPQTFAYRAIKDSDYAKDLPSDIFNTLKQDVFKHFNETKKEQLRGERSLTTYKRGIPVPFNLMKKNVIVSDGDNYYLTWFEETRFKLNFGKDRSNNRAIIDNCLKTNKYKLCTAAKIQLKNKKLFLLVTVDIPETKNKIIKGKVMGVDLGVVHPAYVAVNDGPERSLIGDGDAFQKQRDVFRRRFRELQRCQLTQGGHGRKHKTKATENLRGKERNWVQTENHRISREIVNLAIRWRVETIQMENLKGFGKDSDGDVETKHQRLLGRWSYFELQKDIEYKAAMAGIKVVYVNPAYTSQTCHVCGERGDRTERDTFICTNTECDCYGKPQDADMNAAINIARSKNIVK

SEQ ID NO: 234 - protein, 427 aa, Artificial Sequence
  Description of Artificial Sequence: Synthetic polypeptide
  CasM.296642
MTKVVKLPLICEQSDKDGNPIDYKKIYEILFELQRQTREIKNKSIQYCWEFSNFSSDYYKQNHEYPKEKDILSYTLVGFVNDKFKTGNDLYSGNCSTTVRGACGEFKNSKTDFLKGTKSIINYKGNQPLDLHNKTIRFECIGKDYYAYLKLLNRPAFQRNNFSSSEIKFKVLVYDNSSKTIVERCIDNIYKISASKLIYNEKKKCWVLNLSYSFTNNNVCELDENKILGVDLGIHYPICASVNGERKFFKIDGGEIDHTRRKIEVRKKSLLKQGSSCGEGRIGHGIKTRNKPVYNIEDKIACFRDTANHKYSRALINYAVNNNCGIIQMEKLTGITADSDRFLKNWSYFDLQTKIEYKAKEAGITVVYIDPQYTSQRCSKCGYISKENRKVQAKFCCQKCGYEANADYNASQNIGIKDIDKIIKNTK

SEQ ID NO: 235 - protein, 472 aa, Artificial Sequence
  Description of Artificial Sequence: Synthetic polypeptide
  CasM.298142
VPITKTISLRILRPYYPPEIEAKIKAEKEKRKENGDTGSLNSSYYRELKKEYPSIIINDEFFPLLSEMQRNITSIYNRTISHLYHRLIIKKESISTAKALSEGPYRDFKSTFNSYIALGLRQKVQSNFRKKDLMAFKIALPTAKSDKFPIPIYMQTNFKIKESPDSDFIIELPLVEYIAKETKGKNKMFTKVEILSPPKVKNIPVILSTRRRKESGQWFSDEGTNAEIRRIISGEYKVSWIEIVKRTRFGKHDWFVNMVISFEESQEGLDPDVIGGIDIGVSKPLICAINNSLDRYIVKGDDIIAFNRRALSRRRSLLRRNRLKRSGHGSRNKLEPITVLTEKNERFKKSIMQRWAKEVAEFFKSKRASIVQMEELTGIKEREDFFSKTLRMYWNYGQLQKTVENKLREYGIEVRYASPKDTSRRCHSCGHINDYFTFEFRQQNNFPLFKCMNCGIECSADYNAARNIAIAR

SEQ ID NO: 236 - protein, 1331 aa, Artificial Sequence
  Description of Artificial Sequence: Synthetic polypeptide
  CasM.298248
MNRIYQGRVSKVEIPDGKDEWKKLDDGESALWQHHQLFQDDVNYLLAAFAALVPTSCEDDIWKDYQAAIERSWESYTGRQGIWDRPFENACVIVGCKKDASFKEFRRKLNSLTGSKASEKQKFEALKQLFEPATEAAKKLKKHDEPVEESLKGKAKDLFGSTLVNLCAQKTKVTPRDVIAKQRNRASECTKKVNEGERLKWADVFYFKTDTSAAKWSREDAAKNIIQFLDKLLGEVEEKEKDAKTSDQKKKMADLAERLEKQKKPLAAWCNNSKTDLPTTEPTRKGSGGYDLKAAVLFSLQPDLDGFRDAFLLFNQARLKEEFATTEKGDAAYIARMAGGVARPVFPFFCDVWAGKVNDEKIGQGIWPDFEKQAFSEVFTKIGQFIVRGRKFELRLAIADQIIAKIETQKKSDARLQAVERIAEDLADELPDTAVDENGQKRPYGIRERTLKGWRKVRPAWREALKKTPNLTAEDLIKQKNRMQERQREKYGSASLFDRLAKEPEIWNHDDKEDAVETWADYVENLEEKAHLETERLFAPAHATLSPRFFRWSETNNKEHLEASSPDVPFELKADALDLSKKEKSQIKIHFWSPRLWRDGLRGKKENLDKDEPDQNWMPPVLRAFVKARKWPCDKQSFAGASVRLAPRCKENIQLVFEPELHTEILSAKWKENFPFSPAKNKESESVGLFWPRTKEDKVLWFDKGETRCLGVDLGLTNSAAWQILQATNKDATAKAPRLRHRLNPDSEKAAWFAHSITNGIVRVAGEDCWGWRKFAPDEKAKLRAELKKPAGKRNALCRKFLSLNREIEFETATHSFLPELSGSGGRNPTDDETKEAAEFFSTLKTKGFDITDRQPSWGKNLSFPKQNDELLWGLKRVRAQLFRLNRWSEQLGKERDSKPYQSAIEIIGNLRSDDPLIELATLKSEPKRLKSRIAELAGEYLDCFKTLLPRIADRILPWRRGHWSWKPCDNDWHRMELDASKPRPEALLAGQRGISLPRLNQLKDLRQLAQSLNHLCRRKQIKRNETVPEPFEDCRQAMEDAREDRAKKIAHEVFAIALGVELAPPPPDKQERKQTESLHGVYRCLERGPVNFIALENLGGYNPSAKQGRRENRQLSSWLKGRIHKILGELCEMVGMPIVLVNAEYTSRFSAKDHSPGFRAEEVQTDDSRRSFWQRKAKEEPSGWQNEFLCWLNKVPDGKSLLLPKKGGEFFVPLGEGTSLYHADLNAAYRIALRALAHRDRAELLGQTWIEKKPYLVDVAGVFPDSILRNGCAFKTISSSERLWEKVNGDLAMQRCREINLARFASWKIALPQQIISEALPPDEEDDIPM

SEQ ID NO: 237 - protein, 517 aa, Artificial Sequence
  Description of Artificial Sequence: Synthetic polypeptide
  CasM.298264
MSEATKTLAYRYRLRLTPAQEDILDRSQEQLRLVWNHLVRSQHKVEHEWRHGRAASIKNELLELSLAKNATGQAIPSARKITEERGVSMEEALRLMRQKFVEKVSAIPLRKKDGSRCLRIARRKMATEYAVTVVNAKFKHYYGLGARMCKVLRDKFQKCSDMWIKGKFRRPRFKRKGESVALQRQVQSNSPFKLKRFSDLSALGGQALKKCEVIIHRPLPDSAEIKQIAVSGRRGQRHLIVMFKAASSDVAKNFPATNRTAGVDPGIKVALTITPLDSPDFGTSDKIEKQPDLARDACFLKRLRRLQRKHDRQRRQNNPECFDEKGRWIKGKRLHNESKNMQRTQSRITAMNTHLAESRRDFYHNAACEILRSFDNVAVGKWRPAQTRQRKPTTPSPKGLGAARRATNRISYDHAISLFISYLKDKAERSVTTKHVQEVSEFGSTRSCPKCGKLTGPVGTEGLAVRDWTCVNCNTTFQRDAASAWQIAKRFKAEVASTSQPAESQDSANSASVLTQV

SEQ ID NO: 238 - protein, 470 aa, Artificial Sequence
  Description of Artificial Sequence: Synthetic polypeptide
  CasM.298446
MPTLTRKVELYVVGDKEEVSRVYDYIRLAMNATYKCFNECMTALYIAQVKEDTKEDRKELNHLYSRQTYTKKETAFTNDIVFPEGLALAAYVNRMAQQKFVTSLKNGLMYGCVSLPTFKKDCAVPLHVKFVSLAGEKGTNTGFYHEYADVNDLVNALEYDNSPKVFLRFPNNITFGVVFGNPYRGREQRSVFSKIFLGEYKIQGSSIQINSRGKIILNLSMEVPKKKMEHIEGRVVGVDVGLAIPAMCAINDDDYTRSAIGNIDDFLKVRTQIQSQRRRLQKSLKNTSSGHGRTKKLKPLERIAEKERNFANTYNHMVSKRVVDFAVKNGASQINIEDLSGFAKDKNGKSVEDDNMKRVLSNWSYFELQQQIRYKAEQYDIKVRTVNPAYTSQTCSYCGQIGKRETQSKFVCTNPDCKCHKMYKKDWFNADFNAARNIALSTDYTDDEDGKKTKKKKSAKKKPEKKTEEA

SEQ ID NO: 239 - protein, 500 aa, Artificial Sequence
  Description of Artificial Sequence: Synthetic polypeptide
  CasM.298612
MSGASGQITRDNKAQRSGPNKGEMSEDHSSTKRPKRVVKVAKYRIIKPVGEMTWPELGEILRTVRYRVFRLGNLAVSEAYLNFHAFRTGKAEEFKSETIGKLSRRLRDMLISEGVKKEDIDRYSATGAVPDTVAGALGQYKVRGITSPAKWRQVIRGTVSLPTFRNDMAIPVRCDKPAQRRLEKAKSEEVEVDLMICRKPYPRVLIGTADLGGGQQAILERLLDNKDNSSDGYRQRLFEIKQDTQSKKWFLFVTYDFPSSGALPLDPNVAVGVDLGVSVPLYAAINNGHARLGRRQFQALGSRIRSLQTQVDARRRAIQRGGRSDVSQSTARSGHGVRRKLQPTEKLRKRIDRSYSTLNHQLSAAVVEFAKNQGAGTVQMEDLGGLREELTGTFIGARWRYHQLQQFLEYKCDEAGITLNKVNPMYTSRRCSECGFIDKDFDRAFRDRSRSDGRVARFICPECSYEADPDYNAARNIATLDIDKLIRVQCQKQGLKYDAL

SEQ ID NO: 240 - protein, 459 aa, Artificial Sequence
  Description of Artificial Sequence: Synthetic polypeptide
  CasM.299584
MIITRKIELWLSEDDNELRKAKWSYLKELNDEVYRAANFIVNNQYFNEILENRVIMQDTRLIDIDSEIRKLYKSREKNKEKIDELKKIKKIRYQEAKNFYQTSKQNVTYQLTSREFPNIPANIVTSLNASIIKTLKTEWNEIKSGKRAVRNYRKGMPIPFNFSSSQKWFENKGEDIFLNWLGGLKFKLFFGRDKSNNRAIVERAINKEYKYADSSIQLKDKKIFLLFVVDIPYEKANLNKNIAAGVDLGIAFPAFCALSEGYSRLSIGNKEDLLKVRLQMQSRRKRLQKALKITSGGKGRTKKLKALESLTNKEKNYVTTYNHKVSYQVIKFAKDNKAGIIKLEFLEGFGEDEKNKFILRNWSFYQLQKMIEYKAKREGIEVLYIDPYHTSQTCAICGNYEEGQREKQEDFICKNPECKNFEKIVNADYNAALNIAKSNKIVSSSEQCEYNKKHENNVL

SEQ ID NO: 241 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYRTEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 242 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYAREMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 243 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATRMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 244 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATERSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 245 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMRTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 246 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSRQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 247 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTRSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 248 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQRLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 249 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSRSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 250 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLRYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 251 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRRATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 252 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFRTELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 253 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFARELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 254 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATRLETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 255 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATERETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 256 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELRTNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 257 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELERNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 258 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETRIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 259 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNRFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 260 - protein, 468 aa, Artificial Sequence
  Description of Artificial Sequence: Synthetic polypeptide
  Variants of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIRAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 261 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFRKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 262 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKRVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 263 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVRVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 264 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVRGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 265 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVRVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 266 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGRDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 267 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVRLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 268 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDRGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 269 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLRINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 270 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGRNVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 271 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGIRVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 272 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINRPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 273 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVRAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 274 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPRYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 275 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPARVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 276 - protein, 468 aa, Artificial Sequence; identical to SEQ ID NO: 275
  Description of Artificial Sequence: Synthetic polypeptide
  Variant of CasM.19952

SEQ ID NO: 277 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVRTNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 278 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVARNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 279 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATRITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 280 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNRTEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 281 - protein, 468 aa, Artificial Sequence; identical to SEQ ID NO: 280
  Description of Artificial Sequence: Synthetic polypeptide
  Variant of CasM.19952

SEQ ID NO: 282 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITRERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 283 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNRANSKDIIKKNE

SEQ ID NO: 284 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIRNSKDIIKKNE

SEQ ID NO: 285 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIARSKDIIKKNE

SEQ ID NO: 286 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANRKDIIKKNE

SEQ ID NO: 287 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSRDIIKKNE

SEQ ID NO: 288 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKRIIKKNE

SEQ ID NO: 289 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDRIKKNE

SEQ ID NO: 290 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIRKKNE

SEQ ID NO: 291 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKRNE

SEQ ID NO: 292 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKRE

SEQ ID NO: 293 - protein, 468 aa, Artificial Sequence
  Description of Artificial Sequence: Synthetic polypeptide
  Variant of CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNR

SEQ ID NO: 294 - DNA, 20 bp, Artificial Sequence
  Description of Artificial Sequence: Synthetic oligonucleotide
  B2M
gatggatgaaacccagacac

SEQ ID NO: 295 - DNA, 53 bp, Artificial Sequence
  Description of Artificial Sequence: Synthetic oligonucleotide
  Forward Amplicon Primers
tcgtcggcagcgtcagatgtgtataagagacagcccaagtgaaataccctggc

SEQ ID NO: 296 - DNA, 54 bp, Artificial Sequence
  Description of Artificial Sequence: Synthetic oligonucleotide
  Reverse Amplicon Primers
gtctcgtgggctcggagatgtgtataagagacagcagtgggggtgaattcagtg

SEQ ID NO: 297 - DNA, 20 bp, Artificial Sequence
  Description of Artificial Sequence: Synthetic oligonucleotide
  B2M4
ggccgagatgtctcgctccg

SEQ ID NO: 298 - DNA, 53 bp, Artificial Sequence
  Description of Artificial Sequence: Synthetic oligonucleotide
  Forward Amplicon Primers
tcgtcggcagcgtcagatgtgtataagagacagcctctctctaacctggcact

SEQ ID NO: 299 - DNA, 54 bp, Artificial Sequence
  Description of Artificial Sequence: Synthetic oligonucleotide
  Reverse Amplicon Primers
gtctcgtgggctcggagatgtgtataagagacaggagggtaggagagactcacg

SEQ ID NO: 300 - protein, 523 aa, Artificial Sequence
  Description of Artificial Sequence: Synthetic polypeptide
  VPR
DALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 301 - DNA, 7 bp, Artificial Sequence
  Description of Artificial Sequence: Synthetic oligonucleotide
  modified_base (1)..(6): a, c, t, g, unknown or other
nnnnnng

SEQ ID NO: 302 - DNA, 7 bp, Artificial Sequence
  Description of Artificial Sequence: Synthetic oligonucleotide
  modified_base (1)..(6): a, c, t, g, unknown or other
nnnnnnt

SEQ ID NO: 303 - DNA, 7 bp, Artificial Sequence
  Description of Artificial Sequence: Synthetic oligonucleotide
  modified_base (1)..(1): a, c, t, g, unknown or other
  modified_base (3)..(7): a, c, t, g, unknown or other
nrnnnnn

SEQ ID NO: 304 - DNA, 7 bp, Artificial Sequence
  Description of Artificial Sequence: Synthetic oligonucleotide
  modified_base (1)..(2): a, c, t, g, unknown or other
  modified_base (4)..(4): a, c, t, g, unknown or other
nnanrtt

SEQ ID NO: 305 - DNA, 7 bp, Artificial Sequence
  Description of Artificial Sequence: Synthetic oligonucleotide
  modified_base (1)..(2): a, c, t, g, unknown or other
  modified_base (7)..(7): a, c, t, g, unknown or other
nnkrttn

SEQ ID NO: 306 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnncttn

SEQ ID NO: 307 - DNA, 7 bp, Artificial Sequence
  Description of Artificial Sequence: Synthetic oligonucleotide
  modified_base (1)..(3): a, c, t, g, unknown or other
  modified_base (5)..(7): a, c, t, g, unknown or other
nnngnnn

SEQ ID NO: 308 - DNA, 7 bp, Artificial Sequence
  Description of Artificial Sequence: Synthetic oligonucleotide
  modified_base (1)..(3): a, c, t, g, unknown or other
nnngtyg

SEQ ID NO: 309 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnngtyn

SEQ ID NO: 310 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnnkntk

SEQ ID NO: 311 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnnkntt

SEQ ID NO: 312 - DNA, 7 bp, Artificial Sequence
  Description of Artificial Sequence: Synthetic oligonucleotide
  modified_base (1)..(4): a, c, t, g, unknown or other
  modified_base (7)..(7): a, c, t, g, unknown or other
nnnnccn

SEQ ID NO: 313 - DNA, 7 bp, Artificial Sequence
  Description of Artificial Sequence: Synthetic oligonucleotide
  modified_base (1)..(4): a, c, t, g, unknown or other
nnnnccr

SEQ ID NO: 314 - DNA, 7 bp, Artificial Sequence
  Description of Artificial Sequence: Synthetic oligonucleotide
  modified_base (1)..(4): a, c, t, g, unknown or other
nnnnctt

SEQ ID NO: 315 - DNA, 7 bp, Artificial Sequence
  Description of Artificial Sequence: Synthetic oligonucleotide
  modified_base (1)..(5): a, c, t, g, unknown or other
nnnnncc

SEQ ID NO: 316 - DNA, 7 bp, Artificial Sequence
  Description of Artificial Sequence: Synthetic oligonucleotide
  modified_base (1)..(5): a, c, t, g, unknown or other
nnnnncg

SEQ ID NO: 317 - DNA, 7 bp, Artificial Sequence
  Description of Artificial Sequence: Synthetic oligonucleotide
  modified_base (1)..(5): a, c, t, g, unknown or other
nnnnnct

SEQ ID NO: 318 - DNA, 7 bp, Artificial Sequence
  Description of Artificial Sequence: Synthetic oligonucleotide
  modified_base (1)..(5): a, c, t, g, unknown or other
nnnnntg

SEQ ID NO: 319 - DNA, 7 bp, Artificial Sequence
  Description of Artificial Sequence: Synthetic oligonucleotide
  modified_base (1)..(5): a, c, t, g, unknown or other
  modified_base (7)..(7): a, c, t, g, unknown or other
nnnnntn

SEQ ID NO: 320 - DNA, 7 bp, Artificial Sequence
  Description of Artificial Sequence: Synthetic oligonucleotide
  modified_base (1)..(5): a, c, t, g, unknown or other
nnnnnty

SEQ ID NO: 321 - DNA, 7 bp, Artificial Sequence
  Description of Artificial Sequence: Synthetic oligonucleotide
  modified_base (1)..(5): a, c, t, g, unknown or other
  modified_base (7)..(7): a, c, t, g, unknown or other
nnnnnyn

SEQ ID NO: 322 - DNA, 7 bp, Artificial Sequence
  Description of Artificial Sequence: Synthetic oligonucleotide
  modified_base (1)..(5): a, c, t, g, unknown or other
nnnnnyr

SEQ ID NO: 323 - DNA, 7 bp, Artificial Sequence
  Description of Artificial Sequence: Synthetic oligonucleotide
  modified_base (1)..(5): a, c, t, g, unknown or other
nnnnnyt

SEQ ID NO: 324 - DNA, 7 bp, Artificial Sequence
  Description of Artificial Sequence: Synthetic oligonucleotide
  modified_base (1)..(4): a, c, t, g, unknown or other
nnnnrtt

SEQ ID NO: 325 - DNA, 7 bp, Artificial Sequence
  Description of Artificial Sequence: Synthetic oligonucleotide
  modified_base (1)..(4): a, c, t, g, unknown or other
nnnntcg

SEQ ID NO: 326 - DNA, 7 bp, Artificial Sequence
  Description of Artificial Sequence: Synthetic oligonucleotide
  modified_base (1)..(4): a, c, t, g, unknown or other
nnnnkcg

SEQ ID NO: 327 - DNA, 7 bp, Artificial Sequence
  Description of Artificial Sequence: Synthetic oligonucleotide
  modified_base (1)..(4): a, c, t, g, unknown or other
nnnnkyg

SEQ ID NO: 328 - DNA, 7 bp, Artificial Sequence
  Description of Artificial Sequence: Synthetic oligonucleotide
  modified_base (1)..(4): a, c, t, g, unknown or other
nnnntyg

SEQ ID NO: 329 - DNA, 7 bp, Artificial Sequence
  Description of Artificial Sequence: Synthetic oligonucleotide
  modified_base (1)..(4): a, c, t, g, unknown or other
  modified_base (6)..(7): a, c, t, g, unknown or other
nnnntnn

SEQ ID NO: 330 - DNA, 7 bp, Artificial Sequence
  Description of Artificial Sequence: Synthetic oligonucleotide
  modified_base (1)..(4): a, c, t, g, unknown or other
  modified_base (6)..(6): a, c, t, g, unknown or other
nnnntny

SEQ ID NO: 331 - DNA, 7 bp, Artificial Sequence
  Description of Artificial Sequence: Synthetic oligonucleotide
  modified_base (1)..(4): a, c, t, g, unknown or other
nnnnttc

SEQ ID NO: 332 - DNA, 7 bp, Artificial Sequence
  Description of Artificial Sequence: Synthetic oligonucleotide
  modified_base (1)..(4): a, c, t, g, unknown or other
  modified_base (7)..(7): a, c, t, g, unknown or other
nnnnttn

SEQ ID NO: 333 - DNA, 7 bp, Artificial Sequence
  Description of Artificial Sequence: Synthetic oligonucleotide
  modified_base (1)..(4): a, c, t, g, unknown or other
nnnntty

SEQ ID NO: 334 - DNA, 7 bp, Artificial Sequence
  Description of Artificial Sequence: Synthetic oligonucleotide
  modified_base (1)..(4): a, c, t, g, unknown or other
nnnntyc

SEQ ID NO: 335 - DNA, 7 bp, Artificial Sequence
  Description of Artificial Sequence: Synthetic oligonucleotide
  modified_base (1)..(4): a, c, t, g, unknown or other
  modified_base (7)..(7): a, c, t, g, unknown or other
nnnntyn

SEQ ID NO: 336 - DNA, 7 bp, Artificial Sequence
  Description of Artificial Sequence: Synthetic oligonucleotide
  modified_base (1)..(4): a, c, t, g, unknown or other
nnnntyr

SEQ ID NO: 337 - DNA, 7 bp, Artificial Sequence
  Description of Artificial Sequence: Synthetic oligonucleotide
  modified_base (1)..(4): a, c, t, g, unknown or other
nnnnytc

SEQ ID NO: 338 - DNA, 7 bp, Artificial Sequence
  Description of Artificial Sequence: Synthetic oligonucleotide
  modified_base (1)..(4): a, c, t, g, unknown or other
  modified_base (7)..(7): a, c, t, g, unknown or other
nnnnytn

SEQ ID NO: 339 - DNA, 7 bp, Artificial Sequence
  Description of Artificial Sequence: Synthetic oligonucleotide
  modified_base (1)..(4): a, c, t, g, unknown or other
nnnnyty

SEQ ID NO: 340 - DNA, 7 bp, Artificial Sequence
  Description of Artificial Sequence: Synthetic oligonucleotide
  modified_base (1)..(4): a, c, t, g, unknown or other
nnnnywc

SEQ ID NO: 341 - DNA, 7 bp, Artificial Sequence
  Description of Artificial Sequence: Synthetic oligonucleotide
  modified_base (1)..(3): a, c, t, g, unknown or other
  modified_base (5)..(6): a, c, t, g, unknown or other
nnnrnng

SEQ ID NO: 342 - DNA, 7 bp, Artificial Sequence
  Description of Artificial Sequence: Synthetic oligonucleotide
  modified_base (1)..(3): a, c, t, g, unknown or other
  modified_base (6)..(6): a, c, t, g, unknown or other
nnnrtng

SEQ ID NO: 343 - DNA, 7 bp, Artificial Sequence
  Description of Artificial Sequence: Synthetic oligonucleotide
  modified_base (1)..(3): a, c, t, g, unknown or other
nnnrtrg

SEQ ID NO: 344 - DNA, 7 bp, Artificial Sequence
  Description of Artificial Sequence: Synthetic oligonucleotide
  modified_base (1)..(3): a, c, t, g, unknown or other
nnnrttg

SEQ ID NO: 345 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnnrttn

SEQ ID NO: 346 - DNA, 7 bp, Artificial Sequence
  Description of Artificial Sequence: Synthetic oligonucleotide
  modified_base (1)..(3): a, c, t, g, unknown or other
nnnrtwg

SEQ ID NO: 347 - DNA, 7 bp, Artificial Sequence
  Description of Artificial Sequence: Synthetic oligonucleotide
  modified_base (1)..(3): a, c, t, g, unknown or other
nnntkcg

SEQ ID NO: 348 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnntncg

SEQ ID NO: 349 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnntntg

SEQ ID NO: 350 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
  modified_base (7)..(7): a, c, t, g, unknown or other
nnntnyn

SEQ ID NO: 351 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnnttcn

SEQ ID NO: 352 - DNA, 7 bp, Artificial Sequence
  Description of Artificial Sequence: Synthetic oligonucleotide
  modified_base (1)..(3): a, c, t, g, unknown or other
  modified_base (6)..(6): a, c, t, g, unknown or other
nnnttny

SEQ ID NO: 353 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnntttn

SEQ ID NO: 354 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnnttyn

SEQ ID NO: 355 - DNA, 7 bp, Artificial Sequence
  Description of Artificial Sequence: Synthetic oligonucleotide
  modified_base (1)..(3): a, c, t, g, unknown or other
nnntyct

SEQ ID NO: 356 - DNA, 7 bp, Artificial Sequence
  Description of Artificial Sequence: Synthetic oligonucleotide
  modified_base (1)..(3): a, c, t, g, unknown or other
  modified_base (7)..(7): a, c, t, g, unknown or other
nnntyyn

SEQ ID NO: 357 - DNA, 7 bp, Artificial Sequence
  Description of Artificial Sequence: Synthetic oligonucleotide
  modified_base (1)..(3): a, c, t, g, unknown or other
nnntyyw

SEQ ID NO: 358 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnnwnct

SEQ ID NO: 359 - DNA, 7 bp, Artificial Sequence
  Description of Artificial Sequence: Synthetic oligonucleotide
  modified_base (1)..(3): a, c, t, g, unknown or other
nnntyyt

SEQ ID NO: 360 - DNA, 7 bp, Artificial Sequence
  Description of Artificial Sequence: Synthetic oligonucleotide
  modified_base (1)..(3): a, c, t, g, unknown or other
  modified_base (5)..(5): a, c, t, g, unknown or other
nnnwntg

SEQ ID NO: 361 - DNA, 7 bp, Artificial Sequence
  Description of Artificial Sequence: Synthetic oligonucleotide
  modified_base (1)..(3): a, c, t, g, unknown or other
nnnwytg

SEQ ID NO: 362 - DNA, 7 bp, Artificial Sequence
  Description of Artificial Sequence: Synthetic oligonucleotide
  modified_base (1)..(3): a, c, t, g, unknown or other
nnnyttr

SEQ ID NO: 363 - DNA, 7 bp, Artificial Sequence
  Description of Artificial Sequence: Synthetic oligonucleotide
  modified_base (1)..(2): a, c, t, g, unknown or other
nnrgtyg

SEQ ID NO: 364 - DNA, 6 bp, Artificial Sequence
  Description of Artificial Sequence: Synthetic oligonucleotide
  modified_base (1)..(2): a, c, t, g, unknown or other
  modified_base (4)..(4): a, c, t, g, unknown or other
nntntr

SEQ ID NO: 365 - DNA, 7 bp, Artificial Sequence
  Description of Artificial Sequence: Synthetic oligonucleotide
  modified_base (1)..(2): a, c, t, g, unknown or other
  modified_base (7)..(7): a, c, t, g, unknown or other
nntttyn

SEQ ID NO: 366 - DNA, 7 bp, Artificial Sequence
  Description of Artificial Sequence: Synthetic oligonucleotide
  modified_base (1)..(2): a, c, t, g, unknown or other
  modified_base (7)..(7): a, c, t, g, unknown or other
nnwttyn

SEQ ID NO: 367 - DNA, 7 bp, Artificial Sequence
  Description of Artificial Sequence: Synthetic oligonucleotide
  modified_base (1)..(2): a, c, t, g, unknown or other
  modified_base (7)..(7): a, c, t, g, unknown or other
nnwwttn

SEQ ID NO: 368 - DNA, 4 bp, Artificial Sequence
  Description of Artificial Sequence: Synthetic oligonucleotide
  modified_base (2)..(2): a, c, t, g, unknown or other
tntg

SEQ ID NO: 369 - DNA, 4 bp, Artificial Sequence
  Description of Artificial Sequence: Synthetic oligonucleotide
  modified_base (1)..(1): a, c, t, g, unknown or other
ntcg

SEQ ID NO: 370 - DNA, 4 bp, Artificial Sequence
  Description of Artificial Sequence: Synthetic oligonucleotide
rttr

SEQ ID NO: 371 - DNA, 4 bp, Artificial Sequence
  Description of Artificial Sequence: Synthetic oligonucleotide
  modified_base (1)..(1): a, c, t, g, unknown or other
nttc

SEQ ID NO: 372 - RNA, 108 nt, Artificial Sequence
  Description of Artificial Sequence: Synthetic polynucleotide
  crRNA guide nucleic acid
agggcgacuucccguccugaaaucgagaaagugacaaggaaagcgcaauuuugcgccguuguaauacacucgagaaggucaagguguacauaguaauccguacacgac

SEQ ID NO: 373 - RNA, 149 nt, Artificial Sequence
  Description of Artificial Sequence: Synthetic polynucleotide
  sgRNA guide nucleic acid
agggcgacuucccguccugaaaucgagaaagugacaaggaaagcgcaauuuugcgccguuguaauacacucgagaaggucaagguguacauaguaauccguacacgacgaaagcugggugaguugaagguauuaaauacucguauugcu

SEQ ID NO: 374 - RNA, 180 nt, Artificial Sequence
  Description of Artificial Sequence: Synthetic polynucleotide
  sgRNA guide nucleic acid
agggcgacucggcguccuaaaaucgagaaaguguacauaaguauuuaacaaaauacgguaaauacucucgguaagguuuuaacgugcacauaauaauccgugcaacaggguuacacuuuuguugaaaguugcaacuuacgcauagguguaaaauacgagguauuaaauacucguauugcu

SEQ ID NO: 375 - RNA, 181 nt, Artificial Sequence
  Description of Artificial Sequence: Synthetic polynucleotide
  sgRNA guide nucleic acid
ggggcggcucggcgucccaaaaucgagaaaguauauguaaaucugaauuuauucaguaguagauacacucgauaagguauaaacaauacacauuuuaauccguguauugaacuuauuuagcuauugaaaguugcaauucguaugcgcagguaaguuucgaguauuaaauacucguauugcu

SEQ ID NO: 376 - RNA, 174 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaaugugcaugaggugugaguauuaaauacucguauugcu

SEQ ID NO: 377 - RNA, 118 nt, Artificial Sequence
  Description of Artificial Sequence: Synthetic polynucleotide
  sgRNA guide nucleic acid
uucuuuccucggaaagugguagauacucucgguaagguaaacuguguaugaacaguuugaaauccugcacauaaaaugaaacaggcguaagaugugaguauuaaauacucguauugcu

SEQ ID NO: 378 - RNA, 125 nt, Artificial Sequence
  Description of Artificial Sequence: Synthetic polynucleotide
  sgRNA guide nucleic acid
ucgggcggcucggcguccguaaaccgagaaaguauauguaagucugaauuuauucagcguuagauacacucgguaagguucaaagaaauauggguaugcugcgaguauuaaauacucguauugcu

SEQ ID NO: 379 - RNA, 167 nt, Artificial Sequence
  Description of Artificial Sequence: Synthetic polynucleotide
  sgRNA guide nucleic acid
ucgggcggcucggcguccguaaaccgagaaaguauauguaagucugaauuuauucagcguuagauacacucgguaagguucaaacaauacauauucaauccauguauucaguauauuuguacauuugaaauauggguaugcugcgaguauuaaauacucguauugcu

SEQ ID NO: 380 - RNA, 143 nt, Artificial Sequence
  Description of Artificial Sequence: Synthetic polynucleotide
  sgRNA guide nucleic acid
uagaagguucacacaauuucagggcgacucggcguccuaaaaucgagaaaguguacauaaauuuuuaacaaaauacgguaaauacucucgguaagguuuuaagaaauagguguaaaauacgaguauuaaauacucguauugcu

SEQ ID NO: 381 - RNA, 172 nt, Artificial Sequence
  Description of Artificial Sequence: Synthetic polynucleotide
  sgRNA guide nucleic acid
cagggcgacucggcguccuaaaaucgagaaaguguacauaaauuuuuaacaaaauacgguaaauacucucgguaagguuuuaacgugcacauaauaauccgugcaacaggguuacacuuuugugcaauuuugaaauagguguaaaauacgaguauuaaauacucguauugcu

SEQ ID NO: 382 - RNA, 192 nt, Artificial Sequence
  Description of Artificial Sequence: Synthetic polynucleotide
  sgRNA guide nucleic acid
auaaguugccgccgauaaauauugcgauagcccacgggcaauugcgcaaccggcggcgauaggccgacucgaacggccugaaaguugagaaggcacauguuggaggaaauuuuuuucccauuguguuuucgcucacuaauacacgcaacuugaaaugcgguguaauucgagguauuaaauacucguauugcu

SEQ ID NO: 383 - RNA, 56 nt, Artificial Sequence
  Description of Artificial Sequence: Synthetic oligonucleotide
  crRNA guide nucleic acid
ggugugaacgaccuuuuuuugcgguguaauucgagguauuaaauacucguauugcu

SEQ ID NO: 384 - RNA, 92 nt, Artificial Sequence
  Description of Artificial Sequence: Synthetic oligonucleotide
  crRNA guide nucleic acid
uaggccgacucgaacggccugaaaguugagaaggcacauguuggaggaaauuuuuuucccauuguguuuucgcucacuaauacacgcaacuu

SEQ ID NO: 385 - RNA, 133 nt, Artificial Sequence
  Description of Artificial Sequence: Synthetic polynucleotide
  sgRNA guide nucleic acid
uaggccgacucgaacggccugaaaguugagaaggcacauguuggaggaaauuuuuuucccauuguguuuucgcucacuaauacacgcaacuugaaaugcgguguaauucgagguauuaaauacucguauugcu

SEQ ID NO: 386 - RNA, 136 nt, Artificial Sequence
  Description of Artificial Sequence: Synthetic polynucleotide
  sgRNA guide nucleic acid
uaggccgacucgaacggccugaaaguugagaaggcacauauuagaggaaauuuguuucccauuguguuuucgcucacuaauacacgcaaguuuugaaauugcgguguacuucgagguauuaaauacucguauugcu

SEQ ID NO: 387 - RNA, 190 nt, Artificial Sequence
  Description of Artificial Sequence: Synthetic polynucleotide
  sgRNA guide nucleic acid
uugccggcggcaaaaauugcgauagccuccgggcaauugcgcaaucgccggcgauaggccgacucgaacggccugaaaguugagaaggcacauauuagaggaaauuuguuucccauuguguuuucgcucacuaauacacgcaaguuuugaaauugcgguguacuucgagguauuaaauacucguauugcu

SEQ ID NO: 388 - RNA, 126 nt, Artificial Sequence
  Description of Artificial Sequence: Synthetic polynucleotide
  sgRNA guide nucleic acid
ggggcgacuucccgucccaaaaucgagaaaguggucguaagucucgaucggaucgaagcagacaauacacucgaaaagguuaagugaaaagcguguggcuugaagguauuaaauacucguauugcu

SEQ ID NO: 389 - RNA, 126 nt, Artificial Sequence; identical to SEQ ID NO: 388
  Description of Artificial Sequence: Synthetic polynucleotide
  sgRNA guide nucleic acid

SEQ ID NO: 390 - RNA, 123 nt, Artificial Sequence
  Description of Artificial Sequence: Synthetic polynucleotide
  sgRNA guide nucleic acid
ggggcgacuucccgucccuaaaucgagaaaguggcgguaagacuucggucuucgaagcgcgcaauacacucgaaaagguuaagaaaugaaugcgacuugaagguauuaaauacucguauugcu

SEQ ID NO: 391 - RNA, 149 nt, Artificial Sequence
  Description of Artificial Sequence: Synthetic polynucleotide
  sgRNA guide nucleic acid
ggggcgacuucccgucccuaaaucgagaaaguggcgguaagacuucggucuucgaagcgcgcaauacacucgaaaagguuaagaugcacauaguaauccgugcauggggaaaugaaugcgacuugaagguauuaaauacucguauugcu

SEQ ID NO: 392 - RNA, 85 nt, Artificial Sequence
  Description of Artificial Sequence: Synthetic oligonucleotide
  sgRNA guide nucleic acid
auggggcaguugguugcccuuagccugaggcauuuaaugcacucgggaaguaccgaaaauccaacuauuaaauacucguauugcu

SEQ ID NO: 393 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaagguacauccaacuauuaaauacucguauugcu

SEQ ID NO: 394 - RNA, 103 nt, Artificial Sequence
  Description of Artificial Sequence: Synthetic polynucleotide
  sgRNA guide nucleic acid
auggggcaguugguugcccuuagccugaggcauuuaaugcacucgggaaguaccuuuucucagaaaggaaagguacauccaacuauuaaauacucguauugcu

SEQ ID NO: 395 - RNA, 107 nt, Artificial Sequence
  Description of Artificial Sequence: Synthetic polynucleotide
  sgRNA guide nucleic acid
auggggcaguugguugcccuuagccugaggcauuuaaugcacucgggaaguaccuuuucucagaaaaaaaggaaagguacauccaacuauuaaauacucguauugcu

SEQ ID NO: 396 - RNA, 112 nt, Artificial Sequence
  Description of Artificial Sequence: Synthetic polynucleotide
  sgRNA guide nucleic acid
auggggcaguugguugcccuuagccugaggcauuuaaugcacucgggaaguaccuuuucucagaaaauggcaaaaggaaagguacauccaacuauuaaauacucguauugcu

SEQ ID NO: 397 - RNA, 117 nt, Artificial Sequence
  Description of Artificial Sequence: Synthetic polynucleotide
  sgRNA guide nucleic acid
augaauaggauuuauccuauggggcaguugguugcccuuagccugaggcauuuaaugcacucgggaaguaccuuuucucagaaaagguacauccaacuauuaaauacucguauugcu

SEQ ID NO: 398 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucauucgagguacauccaacuauuaaauacucguauugcu

SEQ ID NO: 399 - RNA, 87 nt, Artificial Sequence
  Description of Artificial Sequence: Synthetic oligonucleotide
  sgRNA guide nucleic acid
auggggcaguugguugcccuuagccugaggcauuuaaugcacucgggagaaaagguacauccaacuauuaaauacucguauugcugu

SEQ ID NO: 400 - RNA, 87 nt, Artificial Sequence; identical to SEQ ID NO: 399
  Description of Artificial Sequence: Synthetic oligonucleotide
  sgRNA guide nucleic acid

SEQ ID NO: 401 - RNA, 92 nt, Artificial Sequence
  Description of Artificial Sequence: Synthetic oligonucleotide
  sgRNA guide nucleic acid
auggggcaguugguugcccuuagccugaggcauuuaaugcacucgggagaaaagguacauccaacuauuaaauacucguauugcuguucgau

SEQ ID NO: 402 - RNA, 95 nt, Artificial Sequence
  Description of Artificial Sequence: Synthetic oligonucleotide
  sgRNA guide nucleic acid
auggggcaguugguugcccuuagccugaggcauuuaaugcacucgggagaaaagguacauccaacuauuaaauacucguauugcuguucgauuau

SEQ ID NO: 403 - RNA, 109 nt, Artificial Sequence
  Description of Artificial Sequence: Synthetic polynucleotide
  crRNA guide nucleic acid
agggcgacuucccguccuaaaaucgagauagugacaagucagucucuuaugaggagcauuguaauacacucgagaaggucaagguguacauaguaauccguacacgacg

SEQ ID NO: 404 - DNA, 7 bp, Artificial Sequence
  Description of Artificial Sequence: Synthetic oligonucleotide
  modified_base (1)..(5): a, c, t, g, unknown or other
nnnnntt

SEQ ID NO: 405 - RNA, 54 nt, Artificial Sequence
  Description of Artificial Sequence: Synthetic oligonucleotide
  crRNA guide nucleic acid
cguugcagcucgcacguuggcacuggguugaagguauuaaauacucguauugcu

SEQ ID NO: 406 - RNA, 123 nt, Artificial Sequence
  Description of Artificial Sequence: Synthetic polynucleotide
  sgRNA guide nucleic acid
ggggcgucuucccgucccuaaaucgagauagcagccauuuuucuucauuuuugaagacggucuugcacucgaaaaggucaaggaaauuggcacugguugaagguauuaaauacucguauugcu

SEQ ID NO: 407 - RNA, 119 nt, Artificial Sequence
  Description of Artificial Sequence: Synthetic polynucleotide
  sgRNA guide nucleic acid
ggggcgucuucccgucccuaaaucgagauagcagccauuuuucuucauuuuugaagacggucuugcacucgaaaaggucaaggaaacacugguugaagguauuaaauacucguauugcu

SEQ ID NO: 408 - RNA, 175 nt, Artificial Sequence
  Description of Artificial Sequence: Synthetic polynucleotide
  sgRNA guide nucleic acid
auauuaagggcggcucagcguccuuaagucgagaaaguauacauaaauuucuuauauagaauaguagauacucucggcaagguauaaacccuacaaauuuaauccuuguaggcaacuuauauuuguauuuauuugaaacauauguagguugugaguauuaaauacucguauugcu

SEQ ID NO: 409 - RNA, 171 nt, Artificial Sequence
  Description of Artificial Sequence: Synthetic polynucleotide
  sgRNA guide nucleic acid
auauuaagggcggcucagcguccuuaagucgagaaaguauacauaaauuucuuauauagaauaguagauacucucggcaagguauaaacccuacaaauuuaauccuuguaggcaacuuauauuuguauuuauuugaaauguagguugugaguauuaaauacucguauugcu

SEQ ID NO: 410 - RNA, 170 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaacaugaggugugaguauuaaauacucguauugcu

SEQ ID NO: 411 - RNA, 131 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauucgaaaugugcaugaggugugaguauuaaauacucguauugcu

SEQ ID NO: 412 - RNA, 127 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauucgaaacaugaggugugaguauuaaauacucguauugcu

SEQ ID NO: 413 - RNA, 56 nt, Artificial Sequence
  Description of Artificial Sequence: Synthetic oligonucleotide
  crRNA guide nucleic acid
gaugugaacgaccuuuuuuugcggugugcuucgagguauuaaauacucguauugcu

SEQ ID NO: 414 - RNA, 151 nt, Artificial Sequence
  Description of Artificial Sequence: Synthetic polynucleotide
  crRNA guide nucleic acid
uaugcugccgccgauaaagguugcgauagcuuucgggcaauugcgcaaccggcggcgauaggccgacucgaacggccugaaaguugagaaggcacauauuagaggaaaauuguuucccauuguguuuucgcucacuaacacacgcaaauuu

SEQ ID NO: 415 - RNA, 56 nt, Artificial Sequence
  Description of Artificial Sequence: Synthetic oligonucleotide
  crRNA guide nucleic acid
aaugugaacgaccuucuuuugcgguguacuucgagguauuaaauacucguauugcu

SEQ ID NO: 416 - RNA, 150 nt, Artificial Sequence
  Description of Artificial Sequence: Synthetic polynucleotide
  crRNA guide nucleic acid
auguugccgccgauaaagguuacgauagccugcgggcaauugcguaaccggcggcgauaggccgacucgaacggccugaagguugagaaggcacaauaaguggaaaauuuguuucuucccauuguguucgcucaccaauacacgcaauuu

SEQ ID NO: 417 - RNA, 56 nt, Artificial Sequence
  Description of Artificial Sequence: Synthetic oligonucleotide
  crRNA guide nucleic acid
auuguaggcgaccuuuuuuugcgauguaguucgagguauuaaauacucguauugcu

SEQ ID NO: 418 - RNA, 98 nt, Artificial Sequence
  Description of Artificial Sequence: Synthetic oligonucleotide
  crRNA guide nucleic acid
aaggccggcucgaacggccugaagguugaguuuaaagucacauauaagcggaaaaaucagauuucccauuguguucgcucaccaauacgcgcaaauuu

SEQ ID NO: 419 - RNA, 149 nt, Artificial Sequence
  Description of Artificial Sequence: Synthetic polynucleotide
  crRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuu

SEQ ID NO: 420 - RNA, 56 nt, Artificial Sequence
  Description of Artificial Sequence: Synthetic oligonucleotide
  crRNA guide nucleic acid
guugcguuugcccgugauuucggguguguauacagguauuaaauacucguauugcu

SEQ ID NO: 421 - RNA, 88 nt, Artificial Sequence
  Description of Artificial Sequence: Synthetic oligonucleotide
  crRNA guide nucleic acid
ggccacccuguuuggccuuaaggugagaagugugcgaguaaguggugaaaaaucgcccguugcccacgcucaccgaaugacccgcacg

SEQ ID NO: 422 - RNA, 56 nt, Artificial Sequence
  Description of Artificial Sequence: Synthetic oligonucleotide
  crRNA guide nucleic acid
gguggauaucaucuuaaaaagugagguacauccaacuauuaaauacucguauugcu

SEQ ID NO: 423 - RNA, 105 nt, Artificial Sequence
  Description of Artificial Sequence: Synthetic polynucleotide
  crRNA guide nucleic acid
gaauaauaauuucgauaugaaugaaaauaguugaauaaaaauauucaaaugggguuguuggaaacccuuaugcugagggcuuaugccacucgguaaguaccuuaa

SEQ ID NO: 424 - RNA, 56 nt, Artificial Sequence
  Description of Artificial Sequence: Synthetic oligonucleotide
  crRNA guide nucleic acid
gggguuguuggaaacccuuaugcugagggcuuaugccacucgguaaguaccuuaaa

SEQ ID NO: 425 - RNA, 165 nt, Artificial Sequence
  Description of Artificial Sequence: Synthetic polynucleotide
  sgRNA guide nucleic acid
gaauaauaauuucgauaugaaugaaaauaguugaauaaaaauauucaaaugggguuguuggaaacccuuaugcugagggcuuaugccacucgguaaguaccuuaagaaagguggauaucaucuuaaaaagugagguacauccaacuauuaaauacucguauugcu

SEQ ID NO: 426 - RNA, 116 nt, Artificial Sequence
  Description of Artificial Sequence: Synthetic polynucleotide
  sgRNA guide nucleic acid
gggguuguuggaaacccuuaugcugagggcuuaugccacucgguaaguaccuuaaagaaagguggauaucaucuuaaaaagugagguacauccaacuauuaaauacucguauugcu

SEQ ID NO: 427 - RNA, 56 nt, Artificial Sequence
  Description of Artificial Sequence: Synthetic oligonucleotide
  crRNA guide nucleic acid
ggcguaugucuaccugaaaaagaagguauauccaacuauuaaauacucguauugcu

SEQ ID NO: 428 - RNA, 98 nt, Artificial Sequence
  Description of Artificial Sequence: Synthetic oligonucleotide
  crRNA guide nucleic acid
aaguuuugaauaacaauaauauucaaauuggggcuguugggggcccuuaugcugagggauuauuccacucggcaaguaccuauauuaauggaggccag

SEQ ID NO: 429 - RNA, 69 nt, Artificial Sequence
  Description of Artificial Sequence: Synthetic oligonucleotide
  crRNA guide nucleic acid
ggggcuguugggggcccuuaugcugagggauuauuccacucggcaaguaccuauauuaauggaggccag

SEQ ID NO: 430 - RNA, 56 nt, Artificial Sequence
  Description of Artificial Sequence: Synthetic oligonucleotide
  crRNA guide nucleic acid
gauguaaaucaucuauaaaagaaagguacauccaacuauuaaauacucguauugcu

SEQ ID NO: 431 - RNA, 85 nt, Artificial Sequence
  Description of Artificial Sequence: Synthetic oligonucleotide
  crRNA guide nucleic acid
cuuuggauuuaaauauucaacgggguuguuggaaacccuuaugcugagggauuauuccacucgguaaguaccuuaaauaguuaua

SEQ ID NO: 432 - RNA, 64 nt, Artificial Sequence
  Description of Artificial Sequence: Synthetic oligonucleotide
  crRNA guide nucleic acid
gggguuguuggaaacccuuaugcugagggauuauuccacucgguaaguaccuuaaauaguuaua

SEQ ID NO: 433 - RNA, 145 nt, Artificial Sequence
  Description of Artificial Sequence: Synthetic polynucleotide
  sgRNA guide nucleic acid
cuuuggauuuaaauauucaacgggguuguuggaaacccuuaugcugagggauuauuccacucgguaaguaccuuaaauaguuauagaaagauguaaaucaucuauaaaagaaagguacauccaacuauuaaauacucguauugcu

SEQ ID NO: 434 - RNA, 124 nt, Artificial Sequence
  Description of Artificial Sequence: Synthetic polynucleotide
  sgRNA guide nucleic acid
gggguuguuggaaacccuuaugcugagggauuauuccacucgguaaguaccuuaaauaguuauagaaagauguaaaucaucuauaaaagaaagguacauccaacuauuaaauacucguauugcu

SEQ ID NO: 435 - RNA, 56 nt, Artificial Sequence
  Description of Artificial Sequence: Synthetic oligonucleotide
  crRNA guide nucleic acid
aguguaugauuaccuguaguaugagguacauccaacuauuaaauacucguauugcu

SEQ ID NO: 436 - RNA, 95 nt, Artificial Sequence
  Description of Artificial Sequence: Synthetic oligonucleotide
  crRNA guide nucleic acid
aaguuuugaauaacaauauuauucaaauuggggcaguuggaugcccuuaugcugagggauuauuccacucggcaaguaccaauaauaauggaugu

SEQ ID NO: 437 - RNA, 66 nt, Artificial Sequence
  Description of Artificial Sequence: Synthetic oligonucleotide
  crRNA guide nucleic acid
ggggcaguuggaugcccuuaugcugagggauuauuccacucggcaaguaccaauaauaauggaugu

SEQ ID NO: 438 - RNA, 56 nt, Artificial Sequence
  Description of Artificial Sequence: Synthetic oligonucleotide
  crRNA guide nucleic acid
gauaguuuuaacuuccauuugaaauguaaaugcaacuauuaaauacucguauugcu

SEQ ID NO: 439 - RNA, 105 nt, Artificial Sequence
  Description of Artificial Sequence: Synthetic polynucleotide
  crRNA guide nucleic acid
ugaaauaugaaauaaauuuuauguaucauuuuuaaaaaacgggugguugcacauccgaagggugaggauuuuuucacucacuaauacuacaaauggaaaaauuua

SEQ ID NO: 440 - RNA, 69 nt, Artificial Sequence
  Description of Artificial Sequence: Synthetic oligonucleotide
  crRNA guide nucleic acid
cgggugguugcacauccgaagggugaggauuuuuucacucacuaauacuacaaauggaaaaauuuaaag

SEQ ID NO: 441 - RNA, 123 nt, Artificial Sequence
  Description of Artificial Sequence: Synthetic polynucleotide
  sgRNA guide nucleic acid
auaggauucguccuauggggcaguugguugcccuuagccugaggcauuuauugcacucgggaaguuccuuaaucuaauggcuuucagaaaagguacauccaacuauuaaauacucguauugcu

SEQ ID NO: 442 - RNA, 107 nt, Artificial Sequence
  Description of Artificial Sequence: Synthetic polynucleotide
  sgRNA guide nucleic acid
ggggcaguugguugcccuuagccugaggcauuuauugcacucgggaaguuccuuaaucuaauggcuuucagaaaagguacauccaacuauuaaauacucguauugcu

SEQ ID NO: 443 - RNA, 123 nt, Artificial Sequence
  Description of Artificial Sequence: Synthetic polynucleotide
  sgRNA guide nucleic acid
auaggauuuauccuauagggcaguugguugcccuuagccugaggcauuuaaugcacucgggaaguaccauauuucuuuagcuaucagaaaagguacauccaacuauuaaauacucguauugcu

SEQ ID NO: 444 - RNA, 107 nt, Artificial Sequence
  Description of Artificial Sequence: Synthetic polynucleotide
  sgRNA guide nucleic acid
agggcaguugguugcccuuagccugaggcauuuaaugcacucgggaaguaccauauuucuuuagcuaucagaaaagguacauccaacuauuaaauacucguauugcu

SEQ ID NO: 445 - RNA, 107 nt, Artificial Sequence; identical to SEQ ID NO: 444
  Description of Artificial Sequence: Synthetic polynucleotide
  sgRNA guide nucleic acid

SEQ ID NO: 446 - RNA, 102 nt, Artificial Sequence
  Description of Artificial Sequence: Synthetic polynucleotide
  sgRNA guide nucleic acid
ggggcaguugguugcccuuagccugaggcauuuauugcacucgggaaguaccauuucuuguugaagaaaugguacauccaacuauuaaauacucguauugcu

SEQ ID NO: 447 - RNA, 131 nt, Artificial Sequence
  Description of Artificial Sequence: Synthetic polynucleotide
  sgRNA guide nucleic acid
aagauaugaauaggaguauuccuauggggcaguugguugcccuuagccugagguauuuaaugcacucgggaaguacuuucaacaguauccguuagaaaagguacauccaacuauuaaauacucguauugcu

SEQ ID NO: 448 - RNA, 106 nt, Artificial Sequence
  Description of Artificial Sequence: Synthetic polynucleotide
  sgRNA guide nucleic acid
ggggcaguugguugcccuuagccugagguauuuaaugcacucgggaaguacuuucaacaguauccguuagaaaagguacauccaacuauuaaauacucguauugcu

SEQ ID NO: 449 - RNA, 124 nt, Artificial Sequence
  Description of Artificial Sequence: Synthetic polynucleotide
  sgRNA guide nucleic acid
aauaggauuuauccuauggggcaguuggaugcccuuagccugaggcauuuuuauugcacucgggaaguacuuucuaaauaacuaucagaaagagcacauccaacuauuaaauacucguauugcu

SEQ ID NO: 450 - RNA, 107 nt, Artificial Sequence
  Description of Artificial Sequence: Synthetic polynucleotide
  sgRNA guide nucleic acid
ggggcaguuggaugcccuuagccugaggcauuuuuauugcacucgggaaguacuuucuaaauaacuaucagaaagagcacauccaacuauuaaauacucguauugcu

SEQ ID NO: 451 - RNA, 123 nt, Artificial Sequence
  Description of Artificial Sequence: Synthetic polynucleotide
  sgRNA guide nucleic acid
auaggauuuauccuauggggcaguugguugcccuuagccugaggcauuuaaugcacucgggaaguaccuuuucucauugaguggcagaaaggguacauccaacuauuaaauacucguauugcu

SEQ ID NO: 452 - RNA, 107 nt, Artificial Sequence
  Description of Artificial Sequence: Synthetic polynucleotide
  sgRNA guide nucleic acid
ggggcaguugguugcccuuagccugaggcauuuaaugcacucgggaaguaccuuuucucauugaguggcagaaaggguacauccaacuauuaaauacucguauugcu

SEQ ID NO: 453 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuuuuucauugagcaacagaaaagguauauccaacuauuaaauacucguauugcu

SEQ ID NO: 454 - RNA, 107 nt, Artificial Sequence
  Description of Artificial Sequence: Synthetic polynucleotide
  sgRNA guide nucleic acid
ggggcaguugguugcccuuagccugaggcauuuauugcacucgggaaguaccuuuuuucauugagcaacagaaaagguauauccaacuauuaaauacucguauugcu

SEQ ID NO: 455 - RNA, 123 nt, Artificial Sequence
  Description of Artificial Sequence: Synthetic polynucleotide
  sgRNA guide nucleic acid
aauaggaauuauccuauggggcaguugguuguccuuagccugagguauuuauugcacucgggaaguacuuuuuacauuaacuaucagaaaggguacauccaacuauuaaauacucguauugcu

SEQ ID NO: 456 - RNA, 106 nt, Artificial Sequence
  Description of Artificial Sequence: Synthetic polynucleotide
  sgRNA guide nucleic acid
ggggcaguugguuguccuuagccugagguauuuauugcacucgggaaguacuuuuuacauuaacuaucagaaaggguacauccaacuauuaaauacucguauugcu

SEQ ID NO: 457 - RNA, 134 nt, Artificial Sequence
  Description of Artificial Sequence: Synthetic polynucleotide
  sgRNA guide nucleic acid
gaauaaugaagaauaggauucguccuauggggcaguugguugcccuuagccugaggaauuuaauucacucgggaaguacuuuucuuauugugugacagaaaggguacauccaacuauuaaauacucguauugcu

SEQ ID NO: 458 - RNA, 106 nt, Artificial Sequence
  Description of Artificial Sequence: Synthetic polynucleotide
  sgRNA guide nucleic acid
ggggcaguugguugcccuuagccugaggaauuuaauucacucgggaaguacuuuucuuauugugugacagaaaggguacauccaacuauuaaauacucguauugcu

SEQ ID NO: 459 - RNA, 53 nt, Artificial Sequence
  Description of Artificial Sequence: Synthetic oligonucleotide
  crRNA guide nucleic acid
guugcaacuuacgcauagguguaaaauacgagguauuaaauacucguauugcu

SEQ ID NO: 460 - RNA, 123 nt, Artificial Sequence
  Description of Artificial Sequence: Synthetic polynucleotide
  crRNA guide nucleic acid
agggcgacucggcguccuaaaaucgagaaaguguacauaaguauuuaacaaaauacgguaaauacucucgguaagguuuuaacgugcacauaauaauccgugcaacaggguuacacuuuuguu

SEQ ID NO: 461 - RNA, 52 nt, Artificial Sequence
  Description of Artificial Sequence: Synthetic oligonucleotide
  crRNA guide nucleic acid
guugcaauucguaugcgcagguaaguuucgaguauuaaauacucguauugcu

SEQ ID NO: 462 - RNA, 125 nt, Artificial Sequence
  Description of Artificial Sequence: Synthetic polynucleotide
  crRNA guide nucleic acid
ggggcggcucggcgucccaaaaucgagaaaguauauguaaaucugaauuuauucaguaguagauacacucgauaagguauaaacaauacacauuuuaauccguguauugaacuuauuuagcuauu

SEQ ID NO: 463 - RNA, 97 nt, Artificial Sequence
  Description of Artificial Sequence: Synthetic oligonucleotide
  sgRNA guide nucleic acid
cgggcgggcuguaccgccuuaugcugagacuuuuucguacucggcaagucaccuaauguugaaaggcuacauacagcuauuaaauacucguauugcu

SEQ ID NO: 464 - RNA, 56 nt, Artificial Sequence
  Description of Artificial Sequence: Synthetic oligonucleotide
  crRNA guide nucleic acid
gguguaugugcaccauauauguaggugacauacagcuauuaaauacucguauugcu

SEQ ID NO: 465 - RNA, 59 nt, Artificial Sequence
  Description of Artificial Sequence: Synthetic oligonucleotide
  crRNA guide nucleic acid
uucgggugggcuguaccaccuuaagcggagggaauuuuccacuccgcaaguuaccuaua

SEQ ID NO: 466 - RNA, 96 nt, Artificial Sequence
  Description of Artificial Sequence: Synthetic oligonucleotide
  sgRNA guide nucleic acid
agggguagcuguuuacccugaaugugaggggcuauugcccacucauaaacuaccuuuugaaaaagguugauacagcuauuaaauacucguauugcu

SEQ ID NO: 467 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacaagucaagccuaaccagggc

SEQ ID NO: 468 - RNA, 124 nt, Artificial Sequence
  Description of Artificial Sequence: Synthetic polynucleotide
  sgRNA guide nucleic acid
gggguuguuggaaacccuuaugcugagggauuauuccacucgguaaguaccuuaaauaguuauagaaagauguaaaucaucuauaaaagaaagguacauccaacgccuggaggcuauccagcgu

SEQ ID NO: 469 - RNA, 117 nt, Artificial Sequence
  Description of Artificial Sequence: Synthetic polynucleotide
  sgRNA guide nucleic acid
augaauaggauucguccuauggggcaguugguugcccuuagccugaggcauuuauugcacucgggaaguaccauuucucagaaaugguacauccaaccgcuacucucucuuucuggc

SEQ ID NO: 470 - RNA, 117 nt, Artificial Sequence
  Description of Artificial Sequence: Synthetic polynucleotide
  sgRNA guide nucleic acid
augaauaggauucguccuauggggcaguugguugcccuuagccugaggcauuuauugcacucgggaaguaccauuucucagaaaugguacauccaacaucucaucaggguacuccug

SEQ ID NO: 471 - RNA, 117 nt, Artificial Sequence
  Description of Artificial Sequence: Synthetic polynucleotide
  sgRNA guide nucleic acid
augaauaggauucguccuauggggcaguugguugcccuuagccugaggcauuuauugcacucgggaaguaccauuucucagaaaugguacauccaacgauggaugaaacccagacac

SEQ ID NO: 472 - RNA, 117 nt, Artificial Sequence
  Description of Artificial Sequence: Synthetic polynucleotide
  sgRNA guide nucleic acid
augaauaggauucguccuauggggcaguugguugcccuuagccugaggcauuuauugcacucgggaaguaccauuucucagaaaugguacauccaacaccagcuugacaucacagga

SEQ ID NO: 473 - RNA, 170 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaacaugaggugugagagugggggugaauucagugu

SEQ ID NO: 474 - RNA, 170 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaacaugaggugugagauagaucgagacauguaagc

SEQ ID NO: 475 - RNA, 170 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaacaugaggugugagauccauccgacauugaaguu

SEQ ID NO: 476 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacggggaggguuucucuuccgc

SEQ ID NO: 477 - RNA, 174 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaaugugcaugaggugugaguggccuggaggcuauccagc

SEQ ID NO: 478 - RNA, 174 nt, Artificial Sequence
  Description of Artificial Sequence: Synthetic polynucleotide
  sgRNA guide nucleic acid
aaacaagggcggcucaacguccuagaaucgagaaaguaugcguaagacuuauuuauugagcgguagauacucucgguaagguauaaauuccacaaugaaaauccuguggacaccguauaauaugugcauguuugaaaugugcaugaggugugagagugggggugaauucagugu

SEQ ID NO: 479 - RNA, 174 nt, Artificial Sequence; identical to SEQ ID NO: 478
  Description of Artificial Sequence: Synthetic polynucleotide
  sgRNA guide nucleic acid

SEQ ID NO: 480 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacacugcucggaccugcauuuu

SEQ ID NO: 481 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaaccugcuuuuacuauuaguggu

SEQ ID NO: 482 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucugggcgcccgcuaaguuc

SEQ ID NO: 483 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacuucaggcgcccgcuaaguuc

SEQ ID NO: 484 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgccuacuaaguuc

SEQ ID NO: 485 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaaauuc

SEQ ID NO: 486 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcauccgcuaaguuc

SEQ ID NO: 487 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacccuaggcgcccgcuaaguuc

SEQ ID NO: 488 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuagaugcccgcuaaguuc

SEQ ID NO: 489 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaaccuuaggcgcccgcuaaguuc

SEQ ID NO: 490 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuagauuc

SEQ ID NO: 491 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuggguuc

SEQ ID NO: 492 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgccugcuaaguuc

SEQ ID NO: 493 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaaacgcccgcuaaguuc

SEQ ID NO: 494 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccauuaaguuc

SEQ ID NO: 495 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgccaaguuc

SEQ ID NO: 496 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacuccgggcgcccgcuaaguuc

SEQ ID NO: 497 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacuuuaggcgcccgcuaaguuc

SEQ ID NO: 498 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgccgaguuc

SEQ ID NO: 499 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcuugcuaaguuc

SEQ ID NO: 500 - RNA, 196 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacuccaggcgcccgcuaaguucuggggcaguugguugcccuuagccugaggcauuuauugcacucgggaaguaccauuucucagaaaugguacauccaacuccaggcgcccgcuaaguuc

SEQ ID NO: 501 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuagguuc

SEQ ID NO: 502 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucugagcgcccgcuaaguuc

SEQ ID NO: 503 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaagcgcccgcuaaguuc

SEQ ID NO: 504 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuagacgcccgcuaaguuc

SEQ ID NO: 505 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaagccc

SEQ ID NO: 506 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccguuaaguuc

SEQ ID NO: 507 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcacccgcuaaguuc

SEQ ID NO: 508 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaagcuc

SEQ ID NO: 509 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgucaaguuc

SEQ ID NO: 510 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccacuaaguuc

SEQ ID NO: 511 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggugcccgcuaaguuc

SEQ ID NO: 512 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcucgcuaaguuc

SEQ ID NO: 513 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuagguacccgcuaaguuc

SEQ ID NO: 514 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcugaguuc

SEQ ID NO: 515 - RNA, 98 nt, Artificial Sequence
  Description of Artificial Sequence: Synthetic oligonucleotide
  sgRNA guide nucleic acid
uggggcaguuggaugcccuuagccugaggcauuuauugcacucgggaaguaccauuucucagaaaugguacauccaacucuaggcgcccgcuaaguuc

SEQ ID NO: 516 - RNA, 95 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaag

SEQ ID NO: 517 - RNA, 85 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuacauccaacucuaggcgcccgcuaaguuc

SEQ ID NO: 518 - RNA, 108 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcauguccua

SEQ ID NO: 519 - RNA, 111 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccauugaaaaaugguacauccaacucuaggcgcccgcuaaguuc

SEQ ID NO: 520 - RNA, 105 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcauguc

SEQ ID NO: 521 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcguccgcuaaguuc

SEQ ID NO: 522 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaagucc

SEQ ID NO: 523 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaagucu

SEQ ID NO: 524 - RNA, 107 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcauguccu

SEQ ID NO: 525 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaagugccauuucucagaaaugguacauccaacucuaggcgcccgcuaaguuc

SEQ ID NO: 526 - RNA, 114 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccauuucucagaaaugguacauccaacucuaggcgcccgcuaaguuc

SEQ ID NO: 527 - RNA, 106 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcaugucc

SEQ ID NO: 528 - RNA, 98 nt, Artificial Sequence
  Description of Artificial Sequence: Synthetic oligonucleotide
  sgRNA guide nucleic acid
uggggcaguugguugcccuuagccugaggcauuuaaugcacucgggaaguaccauuucucagaaaugguacauccaacucuaggcgcccgcuaaguuc

SEQ ID NO: 529 - RNA, 104 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcaugu

SEQ ID NO: 530 - RNA, 113 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccauuugaaaaaaugguacauccaacucuaggcgcccgcuaaguuc

SEQ ID NO: 531 - RNA, 101 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgca

SEQ ID NO: 532 - RNA, 107 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccagaaaugguacauccaacucuaggcgcccgcuaaguuc

SEQ ID NO: 533 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaaguuu

SEQ ID NO: 534 - RNA, 100 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgc

SEQ ID NO: 535 - RNA, 95 nt, Artificial Sequence
  Description of Artificial Sequence: Synthetic oligonucleotide
  sgRNA guide nucleic acid
uggggcaguugguugcccuuagccugaggcauuuauugcacucgggaaguaccauugaaaaaugguacauccaacucuaggcgcccgcuaaguuc

SEQ ID NO: 536 - RNA, 97 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuugaaaaaaugguacauccaacucuaggcgcccgcuaaguuc

SEQ ID NO: 537 - RNA, 115 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccauuucgaaagaaaugguacauccaacucuaggcgcccgcuaaguuc

SEQ ID NO: 538 - RNA, 91 nt, Artificial Sequence
  Description of Artificial Sequence: Synthetic oligonucleotide
  sgRNA guide nucleic acid
uggggcaguugguugcccuuagccugaggcauuuauugcacucgggaaguaccagaaaugguacauccaacucuaggcgcccgcuaaguuc

SEQ ID NO: 539 - RNA, 99 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaaguucg

SEQ ID NO: 540 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguacuauuucucagaaaugguacauccaacucuaggcgcccgcuaaguuc

SEQ ID NO: 541 - RNA, 103 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcaug

SEQ ID NO: 542 - RNA, 99 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucgaaagaaaugguacauccaacucuaggcgcccgcuaaguuc

SEQ ID NO: 543 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguauauccaacucuaggcgcccgcuaaguuc

SEQ ID NO: 544 - RNA, 102 nt, Artificial Sequence
  Description of Artificial Sequence: Synthetic polynucleotide
  sgRNA guide nucleic acid
uggggcaguugguugcccuuagccugaggcauuuauugcacucgggaaguaccauuucucagaaaugguacauccaacucuaggcgcccgcuaaguucgcau

SEQ ID NO: 545 - RNA, 109 nt, Artificial Sequence
  Description of Artificial Sequence: Synthetic polynucleotide
  sgRNA guide nucleic acid
aauaggauucguccuauggggcaguugguugcccuuagccugaggcauuuauugcacucgggaaguaccaugaaaaugguacauccaacucuaggcgcccgcuaaguuc

SEQ ID NO: 546 - RNA, 97 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaaguu

SEQ ID NO: 547 - RNA, 98 nt, Artificial Sequence
  Description of Artificial Sequence: Synthetic oligonucleotide
  sgRNA guide nucleic acid
uggggcaguugguugcccuuagccugaggaauuuauuucacucgggaaguaccauuucucagaaaugguacauccaacucuaggcgcccgcuaaguuc

SEQ ID NO: 548 - RNA, 93 nt, Artificial Sequence
  Description of Artificial Sequence: Synthetic oligonucleotide
  sgRNA guide nucleic acid
uggggcaguugguugcccuuagccugaggcauuuauugcacucgggaaguaccaugaaaaugguacauccaacucuaggcgcccgcuaaguuc

SEQ ID NO: 549 - RNA, 96 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucuaggcgcccgcuaagu

SEQ ID NO: 550 - RNA, 57 nt, Artificial Sequence
  Description of Artificial Sequence: Synthetic oligonucleotide
  crRNA guide nucleic acid
guugcagaacccgaauagacgaaugaaggaaugcaacugaacgcguggaggggcgcu

SEQ ID NO: 551 - RNA, 57 nt, Artificial Sequence
  Description of Artificial Sequence: Synthetic oligonucleotide
  crRNA guide nucleic acid
guugcagaacccgaauagacgaaugaaggaaugcaacuucccaucacaugucacuuu

SEQ ID NO: 552 - RNA, 57 nt, Artificial Sequence
  Description of Artificial Sequence: Synthetic oligonucleotide
  crRNA guide nucleic acid
guugcagaacccgaauagacgaaugaaggaaugcaaccuauuaguggucguuuuuuu

SEQ ID NO: 553 - RNA, 57 nt, Artificial Sequence
  Description of Artificial Sequence: Synthetic oligonucleotide
  crRNA guide nucleic acid
guugcagaacccgaauagacgaaugaaggaaugcaacucggggggcgggggggagaa

SEQ ID NO: 554 - RNA, 57 nt, Artificial Sequence
  Description of Artificial Sequence: Synthetic oligonucleotide
  crRNA guide nucleic acid
guugcagaacccgaauagacgaaugaaggaaugcaaccagacuggccccagagaugc

SEQ ID NO: 555 - RNA, 57 nt, Artificial Sequence
  Description of Artificial Sequence: Synthetic oligonucleotide
  crRNA guide nucleic acid
guugcagaacccgaauagacgaaugaaggaaugcaacuucuguugauuugucggggg

SEQ ID NO: 556 - RNA, 56 nt, Artificial Sequence
  Description of Artificial Sequence: Synthetic oligonucleotide
  crRNA guide nucleic acid
gcugucaguaguaguaaaaauggggguacauccaacacaucuuucugugugccaag

SEQ ID NO: 557 - RNA, 56 nt, Artificial Sequence
  Description of Artificial Sequence: Synthetic oligonucleotide
  crRNA guide nucleic acid
gcugucaguaguaguaaaaauggggguacauccaaccagccaaaaggcaugcgcuc

SEQ ID NO: 558 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacauaagcgucagagcgccgag

SEQ ID NO: 559 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacucccaaaggcgcggcgcuga

SEQ ID NO: 560 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaacagaaaacggaaacccagaag

SEQ ID NO: 561 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaaccuuugcagacuggccccaga

SEQ ID NO: 562 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacauaagcgucagagcgccgag

SEQ ID NO: 563 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaaccggggccucuggcuccccca

SEQ ID NO: 564 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacucccaaaggcgcggcgcuga

SEQ ID NO: 565 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaaccauguccuagcaccucuggg

SEQ ID NO: 566 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaaccgugcuguuuccuccccacg

SEQ ID NO: 567 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacgggggcgggggggagaaaaa

SEQ ID NO: 568 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacagaaaacggaaacccagaag

SEQ ID NO: 569 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaaccuuugcagacuggccccaga

SEQ ID NO: 570 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacacuggcuggggcaccauuag

SEQ ID NO: 571 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacaagucaagccuaaccagggc

SEQ ID NO: 572 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacguggucguuuuuuucucccc

SEQ ID NO: 573 - RNA, 99 nt, Artificial Sequence
  Description of Artificial Sequence: Synthetic oligonucleotide
  sgRNA guide nucleic acid
auggggcaguugguugcccuuagccugaggaauuuaauucacucgggaaguaccuuucucaugaaaugguacauccaacauuugucggggggcgggggg

SEQ ID NO: 574 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacacuggcuggggcaccauuag

SEQ ID NO: 575 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaaccugcuuuuacuauuaguggu

SEQ ID NO: 576 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacucuuccgccauagauaacua

SEQ ID NO: 577 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacguggucguuuuuuucucccc

SEQ ID NO: 578 - RNA, 99 nt, Artificial Sequence; identical to SEQ ID NO: 577
  Description of Artificial Sequence: Synthetic oligonucleotide
  sgRNA guide nucleic acid

SEQ ID NO: 579 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacauuugucggggggcgggggg

SEQ ID NO: 580 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaugguacauccaacguuggccaggcuggucuuga

SEQ ID NO: 581 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaaccggggccucuggcuccccca

SEQ ID NO: 582 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaacucccaaaggcgcggcgcuga

SEQ ID NO: 583 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaaccccggguaagccugucugcu

SEQ ID NO: 584 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaacagaaaacggaaacccagaag

SEQ ID NO: 585 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaaccuuugcagacuggccccaga

SEQ ID NO: 586 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaacgcgcccuccgaucuggggug

SEQ ID NO: 587 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaaccauguccuagcaccucuggg

SEQ ID NO: 588 - RNA, 99 nt, Artificial Sequence
  Description of Artificial Sequence: Synthetic oligonucleotide
  sgRNA guide nucleic acid
auggggcaguuggaugcccuuagccugaggcauuuauugcacucgggaaguaccuuuucucagaaaugguacauccaacgggggcgggggggagaaaaa

SEQ ID NO: 589 - RNA, 56 nt, Artificial Sequence
  Description of Artificial Sequence: Synthetic oligonucleotide
  sgRNA guide nucleic acid
guuguagucgaccugaaucuguggggugcuuacagggagcaguuaacuggcugggg

SEQ ID NO: 590 - RNA, 56 nt, Artificial Sequence
  Description of Artificial Sequence: Synthetic oligonucleotide
  sgRNA guide nucleic acid
guuguagucgaccugaaucuguggggugcuuacaggagagaugcuaagugacuugc

SEQ ID NO: 591 - RNA, 56 nt, Artificial Sequence
  Description of Artificial Sequence: Synthetic oligonucleotide
  crRNA guide nucleic acid
guuguagucgaccugaaucuguggggugcuuacaggcagagaugcuaagugacuug

SEQ ID NO: 592 - RNA, 52 nt, Artificial Sequence
  Description of Artificial Sequence: Synthetic oligonucleotide
  crRNA guide nucleic acid
gauauaucuuguaugcauauguagguugugaguuguaucccuucaggaaaaa

SEQ ID NO: 593 - RNA, 52 nt, Artificial Sequence
  Description of Artificial Sequence: Synthetic oligonucleotide
  crRNA guide nucleic acid
guugcaaugaacguaugugcaugaggugugaggcggggccucuggcuccccc

SEQ ID NO: 594 - RNA, 52 nt, Artificial Sequence
  Description of Artificial Sequence: Synthetic oligonucleotide
  crRNA guide nucleic acid
guugcaaugaacguaugugcaugaggugugagaucugugagaggcagaagau

SEQ ID NO: 595 - RNA, 57 nt, Artificial Sequence
  Description of Artificial Sequence: Synthetic oligonucleotide
  crRNA guide nucleic acid
guugcagaacccgaauagacgaaugaaggaaugcaacgaaaguucugugccaagaag

SEQ ID NO: 596 - RNA, 57 nt, Artificial Sequence
  Description of Artificial Sequence: Synthetic oligonucleotide
  crRNA guide nucleic acid
guugcagaacccgaauagacgaaugaaggaaugcaacgccuacggcgacgggagggu

SEQ ID NO: 597 - RNA, 57 nt, Artificial Sequence
  Description of Artificial Sequence: Synthetic oligonucleotide
  crRNA guide nucleic acid
guugcagaacccgaauagacgaaugaaggaaugcaacaaugcuaccuagcagaagga

SEQ ID NO: 598 - RNA, 56 nt, Artificial Sequence
  Description of Artificial Sequence: Synthetic oligonucleotide
  crRNA guide nucleic acid
gaugugaacgaccuuuuuuugcgguguacuucgagguauuaaauacucguauugcu

SEQ ID NO: 599 - RNA, 164 nt, Artificial Sequence
  Description of Artificial Sequence: Synthetic polynucleotide
  crRNA guide nucleic acid
uauugucgccgauaagguugcgauagccuacgggcaacugcgcaacuggcggcgauaggccgacucgaacggccugaaggggccuuacggccugaaaaugagaaggcacauauaagagaaaauucguuuuccguuguguucgcucuauccaauacacgcaaauu

SEQ ID NO: 600 - RNA, 56 nt, Artificial Sequence
  Description of Artificial Sequence: Synthetic oligonucleotide
  crRNA guide nucleic acid
gcugcacugcaccgcccauugauggugugcucuagguauuaaauacucguauugcu

SEQ ID NO: 601 - RNA, 155 nt, Artificial Sequence
  Description of Artificial Sequence: Synthetic polynucleotide
  crRNA guide nucleic acid
accgaggccgcgaaaaacacaacgcuagccgaaaggcaaucgcgggugcgcggccgaaggccgacuagagcggccugaagguugagaagcgugcauguaaacggcagaaaaaaugccuuuuguacgcgcucaccgaacacgucugagcgguuuuu

SEQ ID NO: 602 - RNA, 149 nt, Artificial Sequence
  Description of Artificial Sequence: Synthetic polynucleotide
  sgRNA guide nucleic acid
ggccgaccuguacggccugaaggaugagaaggcacauauaaguggaaaauugcuucccguuguguucgcucaccagguacuccuuaauugaaagcugcaagagcuccuaauuugaggggugcauacagguauuaaauacucguauugcu

SEQ ID NO: 603 - RNA, 216 nt, Artificial Sequence
  Description of Artificial Sequence: Synthetic polynucleotide
  sgRNA guide nucleic acid
aguaugaggccgccgauaaacguuucgcuagccugacaggcaaucgcgaacgggcggcugaaggccgaccuguacggccugaaggaugagaaggcacauauaaguggaaaauugcuucccguuguguucgcucaccagguacuccuuaauuuuuuugaaagcugcaagagcuccuaauuugaggggugcauacagguauuaaauacucguauugcu

SEQ ID NO: 604 - RNA, 203 nt, Artificial Sequence
  Description of Artificial Sequence: Synthetic polynucleotide
  crRNA guide nucleic acid
ugaaauauugauugaggucgccguuuacguugcgucacaagggcgcgcgggcgaccgaaggccgaucuguacggccugcagguugagaaggcacauauuagaggaaaauugcuucccuuuguguucgcucaccgaguauuccuuguuuuuugcggcaagaaacugucuuaauuguuuucuggggcagaaguuacagcccaaca

SEQ ID NO: 605 - RNA, 176 nt, Artificial Sequence
  Description of Artificial Sequence: Synthetic polynucleotide
  sgRNA guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuuuuuugaaauguggggugcuuacagguauuaaauacucguauugcu

SEQ ID NO: 606 - RNA, 137 nt, Artificial Sequence
  Description of Artificial Sequence: Synthetic polynucleotide
  sgRNA guide nucleic acid
gaaggccgaccuguacggccuuaagguugagaaggcacauguaaguggaaaaaugcuuucccguuguguucgcucaccaagcacacacguuuuuuugaaauguggggugcuuacagguauuaaauacucguauugcu

SEQ ID NO: 607 - DNA, 95 bp, Artificial Sequence
  Description of Artificial Sequence: Synthetic oligonucleotide
  crRNA guide nucleic acid
aaggccgacctgtacggccttaaggttgagaaggcacatgtcagtggaaaaatgctttccctttgtgttcgctcaccaagcacacgcggtttttt

SEQ ID NO: 608 - DNA, 222 bp, Artificial Sequence
  Description of Artificial Sequence: Synthetic polynucleotide
  crRNA guide nucleic acid
atgaggttcattgaaaagttaactgaggttgtcgtaaatgttgcgctagccataatggcaatcgcgtacaggcaactgaaggccgacctgtacggccttaaggttgagaaggcacatgtcagtggaaaaatgctttccctttgtgttcgctcaccaagcacacgcggtttttttaatgcaataattgcttcaaaggcctgtaaaataatgatttacaacgaa

SEQ ID NO: 609 - DNA, 226 bp, Artificial Sequence
  Description of Artificial Sequence: Synthetic polynucleotide
  crRNA guide nucleic acid
atgctcattgaaaagttaaatgaggtcgccatcaatgtttcgctaacctttaaggtaatcgcgggcaggcgactgaaggccgacctgtacggccttaaggctgagaaggcacatgtaagtggaaaaatgctttcccgttgtgttcgctcaccaagcacatttgtttttttaatgcagttattgctccaacagcctgtaaaatctccagttacaacagatagggttg

SEQ ID NO: 610 - RNA, 107 nt, Artificial Sequence
  Description of Artificial Sequence: Synthetic polynucleotide
  sgRNA guide nucleic acid
ggggcaguugguugcccuuagccugaggcauuuauugcacucgggaaguaccauuuccaauuaaacaacagaaaugguacauccaacuauuaaauacucguauugcu

SEQ ID NO: 611 - DNA, 96 bp, Artificial Sequence
  Description of Artificial Sequence: Synthetic oligonucleotide
  crRNA guide nucleic acid
gaaggccgacctgtacggccttaaggttgagaaggcacatgtaagtggaaaaatgctttcccgttgtgttcgctcaccaagcacacacgttttttt

SEQ ID NO: 612 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgagguauuaaauacucguauugcu

SEQ ID NO: 613 - RNA, 103 nt, Artificial Sequence
  Description of Artificial Sequence: Synthetic polynucleotide
  cr/sgRNA guide nucleic acid
ggggcaguuggaugcccuuaugcugagggauuauuccacucggcaaguaccaauaauaauggaugugaaaagguacauccaacuauuaaauacucguauugcu

SEQ ID NO: 614 - RNA, 106 nt, Artificial Sequence
  Description of Artificial Sequence: Synthetic polynucleotide
  cr/sgRNA guide nucleic acid
cgggugguugcacauccgaagggugaggauuuuuucacucacuaauacuacaaauggaaaaauuuaaaggaaaauguaaaugcaacuauuaaauacucguauugcu

SEQ ID NO: 615 - RNA, 201 nt, Artificial Sequence
  Description of Artificial Sequence: Synthetic polynucleotide
  sgRNA guide nucleic acid
uauugucgccgauaagguugcgauagccuacgggcaacugcgcaacuggcggcgauaggccgacucgaacggccugaaggggccuuacggccugaaaaugagaaggcacauauaagagaaaauucguuuuccguuguguucgcucuauccaauacacgcaaauugaaaguguacuucgagguauuaaauacucguauugcu

SEQ ID NO: 616 - RNA, 124 nt, Artificial Sequence
  Description of Artificial Sequence: Synthetic polynucleotide
  sgRNA guide nucleic acid
gggguuguuggaaacccuuaugcugagggauuauuccacucgguaaguaccuuaaauaguuauagaaagauguaaaucaucuauaaaagaaagguacauccaaccucaugacgcugcggcugug

SEQ ID NO: 617 - RNA, 56 nt, Artificial Sequence
  Description of Artificial Sequence: Synthetic oligonucleotide
  crRNA guide nucleic acid
gcuguaagucauggaaaaauggugaguacauccaacuauuaaauacucguauugcu

SEQ ID NO: 618 - RNA, 80 nt, Artificial Sequence
  Description of Artificial Sequence: Synthetic oligonucleotide
  crRNA guide nucleic acid
auaggaauuauccuauggggcaguugguuguccuuagccugaggcauuuauugcacucgggaaguacuuucgacauuaac

SEQ ID NO: 619 - RNA, 67 nt, Artificial Sequence
  Description of Artificial Sequence: Synthetic oligonucleotide
  crRNA guide nucleic acid
uauggggcaguugguuguccuuagccugaggcauuuauugcacucgggaaguacuuucgacauuaac

SEQ ID NO: 620 - RNA, 122 nt, Artificial Sequence
  Description of Artificial Sequence: Synthetic polynucleotide
  sgRNA guide nucleic acid
auaggaauuauccuauggggcaguugguuguccuuagccugaggcauuuauugcacucgggaaguacuuucgacauuaacgaaaauggugaguacauccaacuauuaaauacucguauugcu

SEQ ID NO: 621 - RNA, 109 nt, Artificial Sequence
  Description of Artificial Sequence: Synthetic polynucleotide
  sgRNA guide nucleic acid
uauggggcaguugguuguccuuagccugaggcauuuauugcacucgggaaguacuuucgacauuaacgaaaauggugaguacauccaacuauuaaauacucguauugcu

SEQ ID NO: 622 - RNA, 61 nt, Artificial Sequence
  Description of Artificial Sequence: Synthetic oligonucleotide
  TracrRNA guide nucleic acid
uggggcaguugguugcccuuagccugaggcauuuauugcacucgggaaguaccauuucuca

SEQ ID NO: 623 - DNA, 4 bp, Artificial Sequence
  Description of Artificial Sequence: Synthetic oligonucleotide
gaaa

SEQ ID NO: 624 - RNA, 13 nt, Artificial Sequence
  Description of Artificial Sequence: Synthetic oligonucleotide
  Repeat sequence guide nucleic acid
ugguauauccaac

SEQ ID NO: 625 - RNA, 20 nt, Artificial Sequence
  Description of Artificial Sequence: Synthetic oligonucleotide
  Spacer sequence guide nucleic acid
gugccuuaguuucuucaucu

SEQ ID NO: 626 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguauauccaacgugccuuaguuucuucaucu

SEQ ID NO: 627 - RNA, 55 nt, Artificial Sequence
  Description of Artificial Sequence: Synthetic oligonucleotide
  TracrRNA guide nucleic acid
uggggcaguugguugcccuuagccugaggcauuuauugcacucgggaaguaccau

SEQ ID NO: 628 - RNA, 10 nt, Artificial Sequence
  Description of Artificial Sequence: Synthetic oligonucleotide
  Repeat Sequence guide nucleic acid
uacauccaac

SEQ ID NO: 629 - RNA, 20 nt, Artificial Sequence
  Description of Artificial Sequence: Synthetic oligonucleotide
  Spacer sequence
ucuaggcgcccgcuaaguuc

SEQ ID NO: 630 - RNA, 13 nt, Artificial Sequence
  Description of Artificial Sequence: Synthetic oligonucleotide
  Repeat Sequence guide nucleic acid
ugguacauccaac

SEQ ID NO: 631 - RNA, 20 nt, Artificial Sequence
  Description of Artificial Sequence: Synthetic oligonucleotide
  Spacer sequence
cgugcuguuuccuccccaca

SEQ ID NO: 632 - RNA, 98 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguacauccaaccgugcuguuuccuccccaca

SEQ ID NO: 633 - RNA, 48 nt, Artificial Sequence
  Description of Artificial Sequence: Synthetic oligonucleotide
  TracrRNA guide nucleic acid
auggggcaguugguugcccuuagccugaggcauuuaaugcacucggga

SEQ ID NO: 634 - DNA, 3 bp, Artificial Sequence
  Description of Artificial Sequence: Synthetic oligonucleotide
aac

SEQ ID NO: 635 - RNA, 20 nt, Artificial Sequence
  Description of Artificial Sequence: Synthetic oligonucleotide
  Spacer sequence
cgugcuguuuccuccccacg

SEQ ID NO: 636 - RNA, 75 nt, Artificial Sequence
  Description of Artificial Sequence: Synthetic oligonucleotide
  sgRNA guide nucleic acid
auggggcaguugguugcccuuagccugaggcauuuaaugcacucgggagaaaaaccgugcuguuuccuccccacg

SEQ ID NO: 637 - RNA, 54 nt, Artificial Sequence
  Description of Artificial Sequence: Synthetic oligonucleotide
  TracrRNA guide nucleic acid
auggggcaguugguugcccuuagccugaggcauuuaaugcacucgggaaguacc

SEQ ID NO: 638 - RNA, 7 nt, Artificial Sequence
  Description of Artificial Sequence: Synthetic oligonucleotide
auccaac

SEQ ID NO: 639 - RNA, 85 nt, Artificial Sequence
  Description of Artificial Sequence: Synthetic oligonucleotide
  sgRNA guide nucleic acid
auggggcaguugguugcccuuagccugaggcauuuaaugcacucgggaaguaccgaaaauccaaccgugcuguuuccuccccacg

SEQ ID NO: 640 - RNA, 62 nt, Artificial Sequence
  Description of Artificial Sequence: Synthetic oligonucleotide
  TracrRNA guide nucleic acid
auggggcaguugguugcccuuagccugaggcauuuaaugcacucgggaaguaccuuuucuca

SEQ ID NO: 641 - RNA, 13 nt, Artificial Sequence
  Description of Artificial Sequence: Synthetic oligonucleotide
  Repeat Sequence guide nucleic acid
agguacauccaac

SEQ ID NO: 642 - RNA, 99 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaagguacauccaaccgugcuguuuccuccccacg

SEQ ID NO: 643 - DNA, 5 bp, Artificial Sequence
  Description of Artificial Sequence: Synthetic oligonucleotide
ccaac

SEQ ID NO: 644 - RNA, 91 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaccaacucuaggcgcccgcuaaguuc

SEQ ID NO: 645 - RNA, 78 nt, Artificial Sequence
  Description of Artificial Sequence: Synthetic oligonucleotide
  Repeat Sequence guide nucleic acid
uggggcaguugguugcccuuagccugaggcauuuauugcacucgggaaguaccauuucucagaaaugguacauccaac

SEQ ID NO: 646 - RNA, 79 nt, Artificial Sequence
  Description of Artificial Sequence: Synthetic oligonucleotide
  Repeat Sequence guide nucleic acid
auggggcaguugguugcccuuagccugaggaauuuaauucacucgggaaguaccuuucucaugaaaugguacauccaac

SEQ ID NO: 647 - RNA, 20 nt, Artificial Sequence
  Description of Artificial Sequence: Synthetic oligonucleotide
  CasM.19952
ccccccacuccccgcugcug

SEQ ID NO: 648 - RNA, 20 nt, Artificial Sequence
  Description of Artificial Sequence: Synthetic oligonucleotide
  CasM.19952
aaguggcauccucucugagc

SEQ ID NO: 649 - RNA, 20 nt, Artificial Sequence
  Description of Artificial Sequence: Synthetic oligonucleotide
  CasM.19952
cuuccucgucugcagccaca

SEQ ID NO: 650 - RNA, 20 nt, Artificial Sequence
  Description of Artificial Sequence: Synthetic oligonucleotide
  CasM.19952
acuuuuccuguuuucucucu

SEQ ID NO: 651 - RNA, 20 nt, Artificial Sequence
  Description of Artificial Sequence: Synthetic oligonucleotide
  CasM.19952
gguuccucggugacccuaga

SEQ ID NO: 652 - RNA, 20 nt, Artificial Sequence
  Description of Artificial Sequence: Synthetic oligonucleotide
  CasM.19952
gugacccuagaaauuggagc

SEQ ID NO: 653 - RNA, 20 nt, Artificial Sequence
  Description of Artificial Sequence: Synthetic oligonucleotide
  CasM.19952
ucugcagccacagaauaugg

SEQ ID NO: 654 - RNA, 20 nt, Artificial Sequence
  Description of Artificial Sequence: Synthetic oligonucleotide
  CasM.19952
aggagccacagagcauugag

SEQ ID NO: 655 - RNA, 20 nt, Artificial Sequence
  Description of Artificial Sequence: Synthetic oligonucleotide
  CasM.19952
gaggagggcgggagacgagc

SEQ ID NO: 656 - RNA, 20 nt, Artificial Sequence
  Description of Artificial Sequence: Synthetic oligonucleotide
  CasM.19952
ucucccgcccuccuccgaca

SEQ ID NO: 657 - RNA, 20 nt, Artificial Sequence
  Description of Artificial Sequence: Synthetic oligonucleotide
  CasM.19952
ccaguuagagacuccgcgga

SEQ ID NO: 658 - RNA, 20 nt, Artificial Sequence
  Description of Artificial Sequence: Synthetic oligonucleotide
  CasM.19952
cucugaucuagaccuaguua

SEQ ID NO: 659 - RNA, 20 nt, Artificial Sequence
  Description of Artificial Sequence: Synthetic oligonucleotide
  CasM.19952
cgccggaaguaggacagagg

SEQ ID NO: 660 - RNA, 20 nt, Artificial Sequence
  Description of Artificial Sequence: Synthetic oligonucleotide
  CasM.19952
aaaggagcgaggacucuuca

SEQ ID NO: 661 - RNA, 20 nt, Artificial Sequence
  Description of Artificial Sequence: Synthetic oligonucleotide
  CasM.19952
cuccuuucgauuucuugucc

SEQ ID NO: 662 - RNA, 20 nt, Artificial Sequence
  Description of Artificial Sequence: Synthetic oligonucleotide
  CasM.19952
auuucuuguccugacacugg

SEQ ID NO: 663 - RNA, 20 nt, Artificial Sequence
  Description of Artificial Sequence: Synthetic oligonucleotide
  CasM.19952
gaacaaggcaaaggcuauaa

SEQ ID NO: 664 - RNA, 20 nt, Artificial Sequence
  Description of Artificial Sequence: Synthetic oligonucleotide
  CasM.19952
aguuauaauaguguguggac

SEQ ID NO: 665 - RNA, 20 nt, Artificial Sequence
  Description of Artificial Sequence: Synthetic oligonucleotide
  CasM.19952
aauauuaguguacuuuagac

SEQ ID NO: 666 - RNA, 20 nt, Artificial Sequence
  Description of Artificial Sequence: Synthetic oligonucleotide
  CasM.19952
uugagccccuuccucgcugc

SEQ ID NO: 667 - RNA, 20 nt, Artificial Sequence
  Description of Artificial Sequence: Synthetic oligonucleotide
  CasM.19952
aagguacaugugcaggaugu

SEQ ID NO: 668 - RNA, 20 nt, Artificial Sequence
  Description of Artificial Sequence: Synthetic oligonucleotide
  CasM.19952
gcaaccaguagcccuugcgu

SEQ ID NO: 669 - RNA, 20 nt, Artificial Sequence
  Description of Artificial Sequence: Synthetic oligonucleotide
  CasM.19952
cacuuucuuucuuuguccuu

SEQ ID NO: 670 - RNA, 20 nt, Artificial Sequence
  Description of Artificial Sequence: Synthetic oligonucleotide
  CasM.19952
guguucaguggauuagaaac

SEQ ID NO: 671 - RNA, 20 nt, Artificial Sequence
  Description of Artificial Sequence: Synthetic oligonucleotide
  CasM.19952
gagaagaagcugcuacaucu

SEQ ID NO: 672 - RNA, 20 nt, Artificial Sequence
  Description of Artificial Sequence: Synthetic oligonucleotide
  CasM.19952
uuaacaaauauuauuagcag

SEQ ID NO: 673 - RNA, 20 nt, Artificial Sequence
  Description of Artificial Sequence: Synthetic oligonucleotide
  CasM.19952
uccuacccccaccccauccc

SEQ ID NO: 674 - RNA, 20 nt, Artificial Sequence
  Description of Artificial Sequence: Synthetic oligonucleotide
  CasM.19952
gagauggacaauggcccggg

SEQ ID NO: 675 - RNA, 20 nt, Artificial Sequence
  Description of Artificial Sequence: Synthetic oligonucleotide
  CasM.19952
cuccguguaccucuguuccu

SEQ ID NO: 676 - RNA, 20 nt, Artificial Sequence
  Description of Artificial Sequence: Synthetic oligonucleotide
  CasM.19952
guggagaagauugaauucag

SEQ ID NO: 677 - RNA, 20 nt, Artificial Sequence
  Description of Artificial Sequence: Synthetic oligonucleotide
  CasM.19952
uacggggugcucuccaagaa

SEQ ID NO: 678 - RNA, 20 nt, Artificial Sequence
  Description of Artificial Sequence: Synthetic oligonucleotide
  CasM.19952
ugggguaaaaaggacaagag

SEQ ID NO: 679 - RNA, 20 nt, Artificial Sequence
  Description of Artificial Sequence: Synthetic oligonucleotide
  CasM.286251
aaaaggcggacgcacuccgg

SEQ ID NO: 680 - RNA, 20 nt, Artificial Sequence
  Description of Artificial Sequence: Synthetic oligonucleotide
  CasM.286251
ggggagggacuccguccaga

SEQ ID NO: 681 - RNA, 20 nt, Artificial Sequence
  Description of Artificial Sequence: Synthetic oligonucleotide
  CasM.286251
gagaccauauucuguggcug

SEQ ID NO: 682 - RNA, 20 nt, Artificial Sequence
  Description of Artificial Sequence: Synthetic oligonucleotide
  CasM.286251
agguguauagguggaaagac

SEQ ID NO: 683 - RNA, 20 nt, Artificial Sequence
  Description of Artificial Sequence: Synthetic oligonucleotide
  CasM.286251
uucucuucggguuccucggu

SEQ ID NO: 684 - RNA, 20 nt, Artificial Sequence
  Description of Artificial Sequence: Synthetic oligonucleotide
  CasM.286251
gagcaaauuacgauugaagu

SEQ ID NO: 685 - RNA, 20 nt, Artificial Sequence
  Description of Artificial Sequence: Synthetic oligonucleotide
  CasM.286251
cgauugaaguuuagaaacau

SEQ ID NO: 686 - RNA, 20 nt, Artificial Sequence
  Description of Artificial Sequence: Synthetic oligonucleotide
  CasM.286251
aaguuuagaaacaugguugg

SEQ ID NO: 687 - RNA, 20 nt, Artificial Sequence
  Description of Artificial Sequence: Synthetic oligonucleotide
  CasM.286251
ucggaggagggcgggagacg

SEQ ID NO: 688 - RNA, 20 nt, Artificial Sequence
  Description of Artificial Sequence: Synthetic oligonucleotide
  CasM.286251
aucucuccugcggguaaaaa

SEQ ID NO: 689 - RNA, 20 nt, Artificial Sequence
  Description of Artificial Sequence: Synthetic oligonucleotide
  CasM.286251
gcuuuucccuuccuucccuc

SEQ ID NO: 690 - RNA, 20 nt, Artificial Sequence
  Description of Artificial Sequence: Synthetic oligonucleotide
  CasM.286251
acauuagcuuuucccuuccu

SEQ ID NO: 691 - RNA, 20 nt, Artificial Sequence
  Description of Artificial Sequence: Synthetic oligonucleotide
  CasM.286251
acuaggucuagaucagagcg

SEQ ID NO: 692 - RNA, 20 nt, Artificial Sequence
  Description of Artificial Sequence: Synthetic oligonucleotide
  CasM.286251
gcgccaaaggauggcuucuc

SEQ ID NO: 693 - RNA, 20 nt, Artificial Sequence
  Description of Artificial Sequence: Synthetic oligonucleotide
  CasM.286251
ggagaagccauccuuuggcg

SEQ ID NO: 694 - RNA, 20 nt, Artificial Sequence
  Description of Artificial Sequence: Synthetic oligonucleotide
  CasM.286251
gggaacuaaucucaacgcug

SEQ ID NO: 695 - RNA, 20 nt, Artificial Sequence
  Description of Artificial Sequence: Synthetic oligonucleotide
  CasM.286251
gucaaguuugccuugucaag

SEQ ID NO: 696 - RNA, 20 nt, Artificial Sequence
  Description of Artificial Sequence: Synthetic oligonucleotide
  CasM.286251
gccagccuugccuugaccaa

SEQ ID NO: 697 - RNA, 20 nt, Artificial Sequence
  Description of Artificial Sequence: Synthetic oligonucleotide
  CasM.286251
gucaaggcaaggcuggccaa

SEQ ID NO: 698 - RNA, 20 nt, Artificial Sequence
  Description of Artificial Sequence: Synthetic oligonucleotide
  CasM.286251
agauaguguggggaaggggc

SEQ ID NO: 699 - RNA, 20 nt, Artificial Sequence
  Description of Artificial Sequence: Synthetic oligonucleotide
  CasM.286251
gcagugguuucuaaggaaaa

SEQ ID NO: 700 - RNA, 20 nt, Artificial Sequence
  Description of Artificial Sequence: Synthetic oligonucleotide
  CasM.286251
gagaaaaacuggaaugacug

SEQ ID NO: 701 - RNA, 20 nt, Artificial Sequence
  Description of Artificial Sequence: Synthetic oligonucleotide
  CasM.286251
guacaugcuuuagcuuuaaa

SEQ ID NO: 702 - RNA, 20 nt, Artificial Sequence
  Description of Artificial Sequence: Synthetic oligonucleotide
  CasM.286251
agagauaauggcaaaaguca

SEQ ID NO: 703 - RNA, 20 nt, Artificial Sequence
  Description of Artificial Sequence: Synthetic oligonucleotide
  CasM.286251
guucggagaagaagcugcua

SEQ ID NO: 704 - RNA, 20 nt, Artificial Sequence
  Description of Artificial Sequence: Synthetic oligonucleotide
  CasM.286251
ugcgggggaagauguagcag

SEQ ID NO: 705 - RNA, 20 nt, Artificial Sequence
  Description of Artificial Sequence: Synthetic oligonucleotide
  CasM.286251
ucuuuuagaauuugggagcc

SEQ ID NO: 706 - RNA, 20 nt, Artificial Sequence
  Description of Artificial Sequence: Synthetic oligonucleotide
  CasM.286251
ggucauugucuuuuagaauu

SEQ ID NO: 707 - RNA, 20 nt, Artificial Sequence
  Description of Artificial Sequence: Synthetic oligonucleotide
  CasM.286251
ugggggagggccggagcugg

SEQ ID NO: 708 - RNA, 20 nt, Artificial Sequence
  Description of Artificial Sequence: Synthetic oligonucleotide
  CasM.286251
ugcguguggggagggggugu

SEQ ID NO: 709 - RNA, 20 nt, Artificial Sequence
  Description of Artificial Sequence: Synthetic oligonucleotide
  CasM.286251
ggggagggaggugugagccu

SEQ ID NO: 710 - RNA, 20 nt, Artificial Sequence
  Description of Artificial Sequence: Synthetic oligonucleotide
  CasM.286251
gccagcgccgccaggcucac

SEQ ID NO: 711 - protein, 10 aa, Artificial Sequence
  Description of Artificial Sequence: Synthetic peptide
  XTEN10 linker
GSPAGSPTST

SEQ ID NO: 712 - protein, 7 aa, Artificial Sequence
  Description of Artificial Sequence: Synthetic peptide
  CasM.19952
PKKKRKV

SEQ ID NO: 713 - protein, 166 aa, Artificial Sequence
  Description of Artificial Sequence: Synthetic polypeptide
  Fusion effector sequences
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 714 - protein, 166 aa, Artificial Sequence
  Description of Artificial Sequence: Synthetic polypeptide
  Fusion effector sequences
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 715 - RNA, 20 nt, Artificial Sequence
  Description of Artificial Sequence: Synthetic oligonucleotide
  Guide Spacer Sequences
cuccguggccuuagcugugc

SEQ ID NO: 716 - RNA, 20 nt, Artificial Sequence
  Description of Artificial Sequence: Synthetic oligonucleotide
  Guide Spacer Sequences
gugaggaagcaccugagccc

SEQ ID NO: 717 - RNA, 20 nt, Artificial Sequence
  Description of Artificial Sequence: Synthetic oligonucleotide
  Guide Spacer Sequences
cugcaucccugcucaggcua

SEQ ID NO: 718 - RNA, 20 nt, Artificial Sequence
  Description of Artificial Sequence: Synthetic oligonucleotide
  Guide Spacer Sequences
uccuggagagaacaggcaau

SEQ ID NO: 719 - RNA, 20 nt, Artificial Sequence
  Description of Artificial Sequence: Synthetic oligonucleotide
  Guide Spacer Sequences
cagcucucagccaccuuccc

SEQ ID NO: 720 - RNA, 20 nt, Artificial Sequence
  Description of Artificial Sequence: Synthetic oligonucleotide
  Guide Spacer Sequences
ggaccuaaagaaacuggagu

SEQ ID NO: 721 - RNA, 20 nt, Artificial Sequence
  Description of Artificial Sequence: Synthetic oligonucleotide
  Guide Spacer Sequences
accagcuugacaucacagga

SEQ ID NO: 722 - RNA, 20 nt, Artificial Sequence
  Description of Artificial Sequence: Synthetic oligonucleotide
  Guide Spacer Sequences
gaacccaaucacugacaggu

SEQ ID NO: 723 - RNA, 20 nt, Artificial Sequence
  Description of Artificial Sequence: Synthetic oligonucleotide
  TRAC_5
gugaauaggcagacagacuu

SEQ ID NO: 724 - RNA, 20 nt, Artificial Sequence
  Description of Artificial Sequence: Synthetic oligonucleotide
  CIITA_15
cagaugcaguuauuguacaa

SEQ ID NO: 725 - RNA, 20 nt, Artificial Sequence
  Description of Artificial Sequence: Synthetic oligonucleotide
  Guide Spacer Sequences
cgagcacagcuaaggccacg

SEQ ID NO: 726 - RNA, 20 nt, Artificial Sequence
  Description of Artificial Sequence: Synthetic oligonucleotide
  Guide Spacer Sequences
cuccaucagccacugaccug

SEQ ID NO: 727 - RNA, 20 nt, Artificial Sequence
  Description of Artificial Sequence: Synthetic oligonucleotide
  Guide Spacer Sequences
gggacgagggugucucgcag

SEQ ID NO: 728 - protein, 469 aa, Artificial Sequence
  Description of Artificial Sequence: Synthetic polypeptide
  CasM.286251
MPTITRKIELTLCTEGLSDQERKDQWNLLYHINDNLYRAANNISSKLYLDDHVGSMVRLKHAEYLSLLRALEKAKKQKAPDEEVIAELSQQVATAEQEMDEQAKAICQYATEMSTQTLSYRFATELETNIFGQILTCLRQGVFSTFNSDARDVKRGERSIRTYKKGMPIPFPWNDSLRIGFEDGEFYLRWYNGLRFRFDFGKDRSNNCLIVQRCMKMDKDYEGDYKLCNSSIQMVKREGKPKFFLLLVVNIPQERVELNKNIVVGVALGINAPAYVATNTTPERKQIGDREHFLNERMAFQRRFKSLQRLKGTTGGRGRAKKLEPLERLRKAEQNWVHTQNHLFSREVIDFAVKARAATIHMEDLSGFGKDNDGNADERKEFVLRNWSYYELQNMITYKAAKYGIKVEKIRPAYTSKTCSWCGHQGFREGITFICENPECKKFGEKEHADYNAARNIANSKEIIKNNEE

SEQ ID NO: 729 - protein, 468 aa, Artificial Sequence
  Description of Artificial Sequence: Synthetic polypeptide
  CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVALGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 730 - protein, 468 aa, Artificial Sequence
  Description of Artificial Sequence: Synthetic polypeptide
  CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVNLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 731 - protein, 468 aa, Artificial Sequence
  Description of Artificial Sequence: Synthetic polypeptide
  CasM.19952
MPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMQDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 732 - protein, 198 aa, Artificial Sequence
  Description of Artificial Sequence: Synthetic polypeptide
  Fusion effector sequences
EASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 733 - protein, 228 aa, Artificial Sequence
  Description of Artificial Sequence: Synthetic polypeptide
SSETGPVAVDPTLRRRIEPHEFEVFFDPRELRKETCLLYEIKWGTSHKIWRHSSKNTTKHVEVNFIEKFTSERHFCPSTSCSITWFLSWSPCGECSKAITEFLSQHPNVTLVIYVARLYHHMDQQNRQGLRDLVNSGVTIQIMTAPEYDYCWRNFVNYPPGKEAHWPRYPPLWMKLYALELHAGILGLPPCLNILRRKQPQLTFFTIALQSCHYQRLPPHILWATGLK

SEQ ID NO: 734 - protein, 40 aa, Artificial Sequence
  Description of Artificial Sequence: Synthetic polypeptide
  XTEN40
GSPAGSPTSTEEGTSESATPESGPGTSTEPSEGSAPGSPA

SEQ ID NO: 735 - protein, 80 aa, Artificial Sequence
  Description of Artificial Sequence: Synthetic polypeptide
  XTEN80
GSPAGSPTSTEEGTSESATPESGPGTSTEPSEGSAPGSPAGSPTSTEEGTSTEPSEGSAPGTSTEPSEGSAPGTSESATP

SEQ ID NO: 736 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacucuaggcgcccgcuaaguuc

SEQ ID NO: 737 - RNA, 104 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaac

SEQ ID NO: 738 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacggacaaaguuuagggcgucg

SEQ ID NO: 739 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacauaagcgucagagcgccgag

SEQ ID NO: 740 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaaccuccguggccuuagcugugc

SEQ ID NO: 741 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacgauggaugaaacccagacac

SEQ ID NO: 742 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacugaugauucugcccuccucc

SEQ ID NO: 743 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacaguacaucuucaagccaucc

SEQ ID NO: 744 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacgaccuaagggagagccagga

SEQ ID NO: 745 - RNA, 124 nt, Artificial Sequence
  Description of Artificial Sequence: Synthetic polynucleotide
  sgRNA guide nucleic acid
aauaggauuuauccuauggggcaguugguugcccuuagccugaggcauuuauugcacucgggaaguaccuuauuucauugagcaacagaaaggguacauccaacggaagauucugauguggaaa

SEQ ID NO: 746 - RNA, 103 nt, Artificial Sequence
  Description of Artificial Sequence: Synthetic polynucleotide
  sgRNA guide nucleic acid
ggggcaguuggaugcccuuaugcugagggauuauuccacucggcaaguaccaauaauaauggaugugaaaagguacauccaacugaguggggcagugggggcg

SEQ ID NO: 747 - RNA, 83 nt, Artificial Sequence
  Description of Artificial Sequence: Synthetic oligonucleotide
  sgRNA guide nucleic acid
ggggcaguuggaugcccuuaugcugagggauuauuccacucggcaaguaccaauaauaauggaugugaaaagguacauccaac

SEQ ID NO: 748 - RNA, 103 nt, Artificial Sequence
  Description of Artificial Sequence: Synthetic polynucleotide
  sgRNA guide nucleic acid
ggggcaguuggaugcccuuaugcugagggauuauuccacucggcaaguaccaauaauaauggaugugaaaagguacauccaacucggggggcgggggggagaa

SEQ ID NO: 749 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaaccucacgucauccagcagaga

SEQ ID NO: 750 - RNA, 86 nt, Artificial Sequence
  Description of Artificial Sequence: Synthetic oligonucleotide
  sgRNA guide nucleic acid
cgggugguugcacauccgaagggugaggauuuauucacucacuaauacuacaaauggaaaaauuuaaaggaaaauguaaaugcaac

SEQ ID NO: 751 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacuugugcuguaggaagcucau

SEQ ID NO: 752 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacaugagagcaagugggcugau

SEQ ID NO: 753 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacagguggcagcggcuugaucc

SEQ ID NO: 754 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacgccaaaggcaugugagguac

SEQ ID NO: 755 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacgggcagcugguggaauuuuu

SEQ ID NO: 756 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaaccagguugagaacuuguugcu

SEQ ID NO: 757 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacucccgacccucccgucgccg

SEQ ID NO: 758 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacggacgagccuacccgucccc

SEQ ID NO: 759 - RNA, 106 nt, Artificial Sequence
  Description of Artificial Sequence: Synthetic polynucleotide
  sgRNA guide nucleic acid
cgggugguugcacauccgaagggugaggauuuauucacucacuaauacuacaaauggaaaaauuuaaaggaaaauguaaaugcaacucggggggcgggggggagaa

SEQ ID NO: 760 - RNA, 214 nt, Artificial Sequence
  Description of Artificial Sequence: Synthetic polynucleotide
  sgRNA guide nucleic acid
ugaaauauugauugaggucgccguuuacguugcgucacaagggcgcgcgggcgaccgaaggccgaucuguacggccugcagguugagaaggcacauauuagaggaaaauugcuucccuuuguguucgcucaccgaguauuccuuguuauuugcggcaagaaacugucuuaauuguuugaaagggugcauacaggaccucaaauuccuccucaga

SEQ ID NO: 761 - RNA, 194 nt, Artificial Sequence
  Description of Artificial Sequence: Synthetic polynucleotide
  sgRNA guide nucleic acid
ugaaauauugauugaggucgccguuuacguugcgucacaagggcgcgcgggcgaccgaaggccgaucuguacggccugcagguugagaaggcacauauuagaggaaaauugcuucccuuuguguucgcucaccgaguauuccuuguuauuugcggcaagaaacugucuuaauuguuugaaagggugcauacagg

SEQ ID NO: 762 - RNA, 159 nt, Artificial Sequence
  Description of Artificial Sequence: Synthetic polynucleotide
  sgRNA guide nucleic acid
aagcaaccgcguacacgcggacgaacggccgaccugcucggccugaagguugagaagguuauguauaagaggagaaaaucccccuucauaaucgcucaccaagcucccaauuuacauauuuugaaagggcgcaugcaggaccucaaauuccuccucaga

SEQ ID NO: 763 - RNA, 139 nt, Artificial Sequence
  Description of Artificial Sequence: Synthetic polynucleotide
  sgRNA guide nucleic acid
aagcaaccgcguacacgcggacgaacggccgaccugcucggccugaagguugagaagguuauguauaagaggagaaaaucccccuucauaaucgcucaccaagcucccaauuuacauauuuugaaagggcgcaugcagg

SEQ ID NO: 764 - RNA, 172 nt, Artificial Sequence
  Description of Artificial Sequence: Synthetic polynucleotide
  sgRNA guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuugaaauguggggugcuuacaggauccaacagccagggggacu

SEQ ID NO: 765 - RNA, 152 nt, Artificial Sequence
  Description of Artificial Sequence: Synthetic polynucleotide
  sgRNA guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuugaaauguggggugcuuacagg

SEQ ID NO: 766 - RNA, 172 nt, Artificial Sequence
  Description of Artificial Sequence: Synthetic polynucleotide
  sgRNA guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuugaaauguggggugcuuacaggauccugugugccccugaugc

SEQ ID NO: 767 - RNA, 172 nt, Artificial Sequence
  Description of Artificial Sequence: Synthetic polynucleotide
  sgRNA guide nucleic acid
uauugcgcuagccauaauggcaaucgcguacaggcaacugaaggccgaccuguacggccuuaagguugagaaggcacauguaaguggaaaaaugcuuucccguuguguucgcucaccaagcacacacguuugaaauguggggugcuuacaggaccucaaauuccuccucaga

SEQ ID NO: 768 - RNA, 212 nt, Artificial Sequence
  Description of Artificial Sequence: Synthetic polynucleotide
  sgRNA guide nucleic acid
aguaugaggccgccgauaaacguuucgcuagccugacaggcaaucgcgaacgggcggcugaaggccgaccuguacggccugaaggaugagaaggcacauauaaguggaaaauugcuucccguuguguucgcucaccagguacuccuuaauuugaaagcugcaagagcuccuaauuugaggggugcauacaggagaaagagagaguagcgcga

SEQ ID NO: 769 - RNA, 192 nt, Artificial Sequence
  Description of Artificial Sequence: Synthetic polynucleotide
  sgRNA guide nucleic acid
aguaugaggccgccgauaaacguuucgcuagccugacaggcaaucgcgaacgggcggcugaaggccgaccuguacggccugaaggaugagaaggcacauauaaguggaaaauugcuucccguuguguucgcucaccagguacuccuuaauuugaaagcugcaagagcuccuaauuugaggggugcauacagg

SEQ ID NO: 770 - RNA, 212 nt, Artificial Sequence
  Description of Artificial Sequence: Synthetic polynucleotide
  sgRNA guide nucleic acid
aguaugaggccgccgauaaacguuucgcuagccugacaggcaaucgcgaacgggcggcugaaggccgaccuguacggccugaaggaugagaaggcacauauaaguggaaaauugcuucccguuguguucgcucaccagguacuccuuaauuugaaagcugcaagagcuccuaauuugaggggugcauacagguacuaugggaucaagccgcu

SEQ ID NO: 771 - RNA, 212 nt, Artificial Sequence
  Description of Artificial Sequence: Synthetic polynucleotide
  sgRNA guide nucleic acid
aguaugaggccgccgauaaacguuucgcuagccugacaggcaaucgcgaacgggcggcugaaggccgaccuguacggccugaaggaugagaaggcacauauaaguggaaaauugcuucccguuguguucgcucaccagguacuccuuaauuugaaagcugcaagagcuccuaauuugaggggugcauacaggaccucaaauuccuccucaga

SEQ ID NO: 772 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgagguccaggccuaaggaaggagu

SEQ ID NO: 773 - RNA, 166 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgagg

SEQ ID NO: 774 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgagguuggugaaguagggccuccu

SEQ ID NO: 775 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgaggaauuccggguaucccaggag

SEQ ID NO: 776 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgagguucauugcagaaagagacau

SEQ ID NO: 777 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgaggagaucacgaggaauacaaca

SEQ ID NO: 778 - RNA, 186 nt, Artificial Sequence
  Description of Artificial Sequence: Synthetic polynucleotide
  sgRNA guide nucleic acid
aacugccgguaagauuacgauagccgaaaggcaauugcguaugcggcaguuaaggccggcucgaacggccugaagguugaguuuaaagucacauauaagcggaaaaaucagauuucccauuguguucgcucaccaauacgcgcaaauuugaaaauguaguucgaggcagccgggaggagcagcaag

SEQ ID NO: 779 - RNA, 190 nt, Artificial Sequence
  Description of Artificial Sequence: Synthetic polynucleotide
  sgRNA guide nucleic acid
accgaggccgcgaaaaacacaacgcuagccgaaaggcaaucgcgggugcgcggccgaaggccgacuagagcggccugaagguugagaagcgugcauguaaacggcagaaaaaaugccuuuuguacgcgcucaccgaacacgucugagcgguuugaaaggugugcucuaggacuaugggaucaagccgcug

SEQ ID NO: 780 - RNA, 170 nt, Artificial Sequence
  Description of Artificial Sequence: Synthetic polynucleotide
  sgRNA guide nucleic acid
accgaggccgcgaaaaacacaacgcuagccgaaaggcaaucgcgggugcgcggccgaaggccgacuagagcggccugaagguugagaagcgugcauguaaacggcagaaaaaaugccuuuuguacgcgcucaccgaacacgucugagcgguuugaaaggugugcucuagg

SEQ ID NO: 781 - RNA, 124 nt, Artificial Sequence; identical to SEQ ID NO: 468
  Description of Artificial Sequence: Synthetic polynucleotide
  sgRNA guide nucleic acid

SEQ ID NO: 782 - RNA, 104 nt, Artificial Sequence
  Description of Artificial Sequence: Synthetic polynucleotide
  sgRNA guide nucleic acid
gggguuguuggaaacccuuaugcugagggauuauuccacucgguaaguaccuuaaauaguuauagaaagauguaaaucaucuauaaaagaaagguacauccaac

SEQ ID NO: 783 - RNA, 124 nt, Artificial Sequence
  Description of Artificial Sequence: Synthetic polynucleotide
  sgRNA guide nucleic acid
gggguuguuggaaacccuuaugcugagggauuauuccacucgguaaguaccuuaaauaguuauagaaagauguaaaucaucuauaaaagaaagguacauccaacacuuuccauucucugcugga

SEQ ID NO: 784 - RNA, 131 nt, Artificial Sequence
  Description of Artificial Sequence: Synthetic polynucleotide
  sgRNA guide nucleic acid
aagauaugaauaggaguauuccuauggggcaguugguugcccuuagccugagguauuuaaugcacucgggaaguacuuucaacaguauccguuagaaaagguacauccaacguguugcuggagggggccuu

SEQ ID NO: 785 - RNA, 111 nt, Artificial Sequence
  Description of Artificial Sequence: Synthetic polynucleotide
  sgRNA guide nucleic acid
aagauaugaauaggaguauuccuauggggcaguugguugcccuuagccugagguauuuaaugcacucgggaaguacuuucaacaguauccguuagaaaagguacauccaac

SEQ ID NO: 786 - DNA, 3 bp, Artificial Sequence
  Description of Artificial Sequence: Synthetic oligonucleotide
ttr

SEQ ID NO: 787 - DNA, 2 bp, Artificial Sequence
  Description of Artificial Sequence: Synthetic oligonucleotide
tr

SEQ ID NO: 788 - DNA, 4 bp, Artificial Sequence
  Description of Artificial Sequence: Synthetic oligonucleotide
tttr

SEQ ID NO: 789 - DNA, 5 bp, Artificial Sequence
  Description of Artificial Sequence: Synthetic oligonucleotide
tttyc

SEQ ID NO: 790 - DNA, 3 bp, Artificial Sequence
  Description of Artificial Sequence: Synthetic oligonucleotide
  modified_base (3)..(3): a, c, t, g, unknown or other
ccn

SEQ ID NO: 791 - DNA, 2 bp, Artificial Sequence
  Description of Artificial Sequence: Synthetic oligonucleotide
tg

SEQ ID NO: 792 - DNA, 5 bp, Artificial Sequence
  Description of Artificial Sequence: Synthetic oligonucleotide
ggtyg

SEQ ID NO: 793 - protein, 50 aa, Artificial Sequence
  Description of Artificial Sequence: Synthetic polypeptide
  Prosite motif
  MOD_RES (1)..(1): K or G
  MOD_RES (2)..(2): E or T
  MOD_RES (4)..(4): V, F, or L
  MOD_RES (5)..(5): L or G
  MOD_RES (6)..(6): R or K
  MOD_RES (9)..(9): S, R, or T
  MOD_RES (11)..(11): Y or F
  MOD_RES (12)..(12): E, D, or Q
  MOD_RES (15)..(15): N or T
  MOD_RES (16)..(16): M or K
  MOD_RES (18)..(18): E or K
  MOD_RES (22)..(22): K or A
  MOD_RES (24)..(24): Y or A
  MOD_RES (29)..(29): V or E
  MOD_RES (30)..(30): K or Y
  MOD_RES (31)..(31): I or V
  MOD_RES (32)..(32): N or R
  MOD_RES (34)..(34): A or K
  MOD_RES (38)..(38): Q, R, or K
  MOD_RES (39)..(39): R or T
  MOD_RES (42)..(42): W or K
  MOD_RES (45)..(45): Y, Q, or H
  MOD_RES (47)..(47): G or D
  MOD_RES (48)..(48): K or F
  MOD_RES (49)..(49): R or D
  MOD_RES (50)..(50): N or F
XXFXXXNWXYXXLQXXIXYKAXEXGIKVXXXXPXYTSXXCSXCGXIXXXX

SEQ ID NO: 794 - protein, 29 aa, Artificial Sequence
  Description of Artificial Sequence: Synthetic peptide
  Prosite motif
  MOD_RES (2)..(2): Q or L
  MOD_RES (5)..(5): L, R, or Q
  MOD_RES (6)..(6): Y or F
  MOD_RES (9)..(9): E or A
  MOD_RES (10)..(10): V or L
  MOD_RES (11)..(11): I or V
  MOD_RES (12)..(12): D, E, or N
  MOD_RES (13)..(13): F or Y
  MOD_RES (17)..(17): N or H
  MOD_RES (20)..(20): G or A
  MOD_RES (23)..(23): Q or H
  MOD_RES (26)..(26): D or N
TXNHXXSRXXXXXAVKXGAXTIXMEXLSG

SEQ ID NO: 795 - protein, 21 aa, Artificial Sequence
  Description of Artificial Sequence: Synthetic peptide
  Prosite motif
  MOD_RES (2)..(2): N or D
  MOD_RES (3)..(3): K or P
  MOD_RES (4)..(4): N, K, or E
  MOD_RES (5)..(5): I or K
  MOD_RES (6)..(6): V or I
  MOD_RES (7)..(7): V or L
  MOD_RES (13)..(13): I or V
  MOD_RES (14)..(14): N or S
  MOD_RES (15)..(15): V or Y
  MOD_RES (17)..(17): L or A
  MOD_RES (19)..(19): A or V
  MOD_RES (20)..(20): A or S
  MOD_RES (21)..(21): T or V
LXXXXXXGVDLGXXXPXYXXX

SEQ ID NO: 796 - protein, 41 aa, Artificial Sequence
  Description of Artificial Sequence: Synthetic polypeptide
  Prosite motif
  MOD_RES (3)..(3): G or N
  MOD_RES (14)..(14): K or R
  MOD_RES (27)..(27): D or E
  MOD_RES (35)..(35): L or M
  MOD_RES (38)..(38): A or D
QWXLLYHINDNLYXAANNISSKLYLDXHVSSMVRXKHXEYL

SEQ ID NO: 797 - protein, 21 aa, Artificial Sequence
  Description of Artificial Sequence: Synthetic peptide
  Prosite motif
  MOD_RES (2)..(2): L or K
  MOD_RES (5)..(5): E or K
  MOD_RES (7)..(7): S or A
  MOD_RES (8)..(8): I or L
  MOD_RES (9)..(9): P or R
  MOD_RES (10)..(10): N, T, or S
  MOD_RES (11)..(11): Y or F
  MOD_RES (12)..(12): K or R
  MOD_RES (13)..(13): K or S
  MOD_RES (14)..(14): G, D, or N
  MOD_RES (15)..(15): M or Q
  MOD_RES (17)..(17): I or L
  MOD_RES (19)..(19): F or I
  MOD_RES (20)..(20): H or P
  MOD_RES (21)..(21): W or C
VXRGXRXXXXXXXXXPXPXXX

SEQ ID NO: 798 - protein, 15 aa, Artificial Sequence
  Description of Artificial Sequence: Synthetic peptide
  Prosite motif
  MOD_RES (1)..(1): N or H
  MOD_RES (7)..(7): A or S
  MOD_RES (8)..(8): R or Q
  MOD_RES (10)..(10): I or L
  MOD_RES (11)..(11): A or S
  MOD_RES (12)..(12): I or N
  MOD_RES (13)..(13): S or K
  MOD_RES (14)..(14): K or D
  MOD_RES (15)..(15): I or D
XADYNAXXNXXXXXX

SEQ ID NO: 799 - protein, 23 aa, Artificial Sequence
  Description of Artificial Sequence: Synthetic peptide
  Prosite motif
  MOD_RES (1)..(1): R or Y
  MOD_RES (2)..(2): L or C
  MOD_RES (3)..(3): G or K
  MOD_RES (4)..(4): G or T
  MOD_RES (5)..(5): T or G
  MOD_RES (7)..(7): G or I
  MOD_RES (9)..(9): H or K
  MOD_RES (13)..(13): K or R
  MOD_RES (14)..(14): K or R
  MOD_RES (18)..(18): L or I
  MOD_RES (19)..(19): E or Y
  MOD_RES (20)..(20): R or K
  MOD_RES (22)..(22): R or E
  MOD_RES (23)..(23): D or G
XXXXXRXGXGRKXXLEPXXXLXX

SEQ ID NO: 800 - protein, 18 aa, Artificial Sequence
  Description of Artificial Sequence: Synthetic peptide
  NLS Sequence
KRPAATKKAGQAKKKKEF

SEQ ID NO: 801 - protein, 9 aa, Artificial Sequence
  Description of Artificial Sequence: Synthetic peptide
  c-Myc NLS
PAAKRVKLD

SEQ ID NO: 802 - protein, 4 aa, Artificial Sequence
  Description of Artificial Sequence: Synthetic peptide
  MOD_RES (3)..(3): K or R
KRXR

SEQ ID NO: 803 - protein, 4 aa, Artificial Sequence
  Description of Artificial Sequence: Synthetic peptide
  MOD_RES (2)..(2): K or R
KXRK

SEQ ID NO: 804 - protein, 7 aa, Artificial Sequence
  Description of Artificial Sequence: Synthetic peptide
  MOD_RES (1)..(1): P or R
  MOD_RES (2)..(3): Any amino acid
  MOD_RES (6)..(6): Any amino acid except D or E
  MOD_RES (7)..(7): K or R
XXXKRXX

SEQ ID NO: 805 - protein, 8 aa, Artificial Sequence
  Description of Artificial Sequence: Synthetic peptide
  NLS Sequence
  MOD_RES (3)..(3): Xaa can be any naturally occurring amino acid
  MOD_RES (4)..(4): Xaa = Tryptophan/ Phenylalanine/ Tyrosine
  MOD_RES (5)..(6): Xaa can be any naturally occurring amino acid
KRXXXXAF

SEQ ID NO: 806 - protein, 7 aa, Artificial Sequence
  Description of Artificial Sequence: Synthetic peptide
  MOD_RES (1)..(1): R or P
  MOD_RES (2)..(3): Any amino acid
  MOD_RES (6)..(6): K or R
  MOD_RES (7)..(7): Any amino acid except D or E
XXXKRXX

SEQ ID NO: 807 - protein, 6 aa, Artificial Sequence
  Description of Artificial Sequence: Synthetic peptide
  NLS Sequence
  MOD_RES (5)..(5): Xaa = Lysine/ Arginine
  MOD_RES (6)..(6): Xaa = Tryptophan/ Phenylalanine/ Tyrosine
LGKRXX

SEQ ID NO: 808 - protein, 19 aa, Artificial Sequence
  Description of Artificial Sequence: Synthetic peptide
  NLS Sequence
  MOD_RES (3)..(14): Xaa can be any naturally occurring amino acid
  SITE (3)..(14): This region may encompass 10-12 residues
KRXXXXXXXXXXXXKKRKR

SEQ ID NO: 809 - protein, 19 aa, Artificial Sequence
  Description of Artificial Sequence: Synthetic peptide
  NLS Sequence
  MOD_RES (3)..(14): Xaa can be any naturally occurring amino acid
  SITE (3)..(14): This region may encompass 10-12 residues
  MOD_RES (18)..(18): Xaa can be any naturally occurring amino acid
  MOD_RES (19)..(19): Xaa = Lysine or Arginine
KRXXXXXXXXXXXXKKRXX

SEQ ID NO: 810 - protein, 15 aa, Artificial Sequence
  Description of Artificial Sequence: Synthetic peptide
  SV40 NLS
PKKKRKVGIHGVPAA

SEQ ID NO: 811 - protein, 9 aa, Artificial Sequence
  Description of Artificial Sequence: Synthetic peptide
  TEV cleavage
ENLYFQSNA

SEQ ID NO: 812 - protein, 879 aa, Artificial Sequence
  Description of Artificial Sequence: Synthetic polypeptide
  Full Uncleaved TEV-Cleavable and MBP tag sequence of CasM. 19952
MKSSHHHHHHHHHHGSSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEENLYFQSNAMPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 813 - protein, 471 aa, Artificial Sequence
  Description of Artificial Sequence: Synthetic polypeptide
  Full cleaved TEV-Cleavable and MBP tag sequence of CasM. 19952
SNAMPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNE

SEQ ID NO: 814 - protein, 510 aa, Artificial Sequence
  Description of Artificial Sequence: Synthetic polypeptide
  Full sequence of His and GFP tagged CasM. 19952
MKSSHHHHHHHGSSMPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNEGSDGGSGGGSTSRDHMVLHEYVNAAGIT

SEQ ID NO: 815 - protein, 547 aa, Artificial Sequence
  Description of Artificial Sequence: Synthetic polypeptide
  Full uncleaved sequence of T2A tagged CasM. 19952
MDYKDHDGDYKDHDIDYKDDDDKMAPKKKRKVGIHGVPAAMPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNEKRPAATKKAGQAKKKKEFGSGEGRGSLLTCGDVEENPGP

SEQ ID NO: 816 - protein, 546 aa, Artificial Sequence
  Description of Artificial Sequence: Synthetic polypeptide
  Cleaved sequence of T2A tagged CasM. 19952
MDYKDHDGDYKDHDIDYKDDDDKMAPKKKRKVGIHGVPAAMPTITRKIELTLLTEGLSEEQRKEQWGLLYHINDNLYKAANNISSKLYLDDHVSSMVRMKHAEYLSLLKELARAEKQKTPDADAIAELRKKVAAAEKEMTDQEHAICKYATEMSTQSLSYRFATELETNIFAKILDCLKQGVFATFNSDARDVKRGERAIRNYKKGMPIPFAWDKSLRIEKDNKDFYLRWYNGLRFLFNFGKDRSNNRLIVERCLKMDADYDGEYKLCNSSIQIAKREGKTKLFLLLVVKIPQEHVELNKKVVVGVDLGINVPAYVATNITEERKAIGDREHFLNSRMAFQRRYKSLQRLRGTAGGKGRAKKLEPLERLRKAEHNWVHTQNHLFSREVVDFAVKSHAATIHMEDLSGFGKDNDGNADERKEFVLRNWSYYELQNMIAYKAAKYGIKVEKIHPAYTSKTCSWCGQLGFREGVTFICENPECKQCGEKVHADYNAARNIANSKDIIKKNEKRPAATKKAGQAKKKKEFGSGEGRGSLLTCGDVEENPG

SEQ ID NO: 817 - protein, 411 aa, Artificial Sequence
  Description of Artificial Sequence: Synthetic polypeptide
  N-terminus sequence of TEV-cleavable MBP tag before CasM. 19952
MKSSHHHHHHHHHHGSSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEENLYFQSNA

SEQ ID NO: 818 - protein, 10 aa, Artificial Sequence
  Description of Artificial Sequence: Synthetic peptide
  10X His tag
HHHHHHHHHH

SEQ ID NO: 819 - protein, 367 aa, Artificial Sequence
  Description of Artificial Sequence: Synthetic polypeptide
  MBP tag
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQT

SEQ ID NO: 820 - protein, 14 aa, Artificial Sequence
  Description of Artificial Sequence: Synthetic peptide
  N-terminus His6 tag plus linker before CasM. 19952
MKSSHHHHHHHGSS

SEQ ID NO: 821 - protein, 28 aa, Artificial Sequence
  Description of Artificial Sequence: Synthetic peptide
  C-terminus Linker-GFP11 tag after CasM. 19952
GSDGGSGGGSTSRDHMVLHEYVNAAGIT

SEQ ID NO: 822 - protein, 40 aa, Artificial Sequence
  Description of Artificial Sequence: Synthetic polypeptide
  N terminus of T2A tagged effector protein
MDYKDHDGDYKDHDIDYKDDDDKMAPKKKRKVGIHGVPAA

SEQ ID NO: 823 - protein, 23 aa, Artificial Sequence
  Description of Artificial Sequence: Synthetic peptide
  3x FLAG tag of N terminus of T2A tagged effector protein
MDYKDHDGDYKDHDIDYKDDDDK

SEQ ID NO: 824 - protein, 39 aa, Artificial Sequence
  Description of Artificial Sequence: Synthetic polypeptide
  C terminus of T2A tagged effector protein
KRPAATKKAGQAKKKKEFGSGEGRGSLLTCGDVEENPGP

SEQ ID NO: 825 - protein, 16 aa, Artificial Sequence
  Description of Artificial Sequence: Synthetic peptide
  NLS (nucleoplasmin) of C terminus of T2A tagged effector protein
KRPAATKKAGQAKKKK

SEQ ID NO: 826 - protein, 21 aa, Artificial Sequence
  Description of Artificial Sequence: Synthetic peptide
  T2A self-cleaving peptide sequence
GSGEGRGSLLTCGDVEENPGP

SEQ ID NO: 827 - RNA, 33 nt, Artificial Sequence
  Description of Artificial Sequence: Synthetic oligonucleotide
  crRNA guide nucleic acid
cguugcagcucgcacguuggcacugguugaagg

SEQ ID NO: 828 - RNA, 34 nt, Artificial Sequence
  Description of Artificial Sequence: Synthetic oligonucleotide
  crRNA guide nucleic acid
cguugcagcucgcacguuggcacuggguugaagg

SEQ ID NO: 829 - RNA, 17 nt, Artificial Sequence
  Description of Artificial Sequence: Synthetic oligonucleotide
  sgRNA guide nucleic acid
uuggcacugguugaagg

SEQ ID NO: 830 - RNA, 13 nt, Artificial Sequence
  Description of Artificial Sequence: Synthetic oligonucleotide
  sgRNA guide nucleic acid
cacugguugaagg

SEQ ID NO: 831 - RNA, 32 nt, Artificial Sequence
  Description of Artificial Sequence: Synthetic oligonucleotide
  crRNA guide nucleic acid
guugcaacucacgcgcguauguggcuugaagg

SEQ ID NO: 832 - RNA, 32 nt, Artificial Sequence
  Description of Artificial Sequence: Synthetic oligonucleotide
  crRNA guide nucleic acid
guugcaauucauaucuccggguggauugaagg

SEQ ID NO: 833 - RNA, 17 nt, Artificial Sequence
  Description of Artificial Sequence: Synthetic oligonucleotide
  sgRNA guide nucleic acid
agcguguggcuugaagg

SEQ ID NO: 834 - RNA, 13 nt, Artificial Sequence
  Description of Artificial Sequence: Synthetic oligonucleotide
  sgRNA guide nucleic acid
uguggcuugaagg

SEQ ID NO: 835 - RNA, 32 nt, Artificial Sequence
  Description of Artificial Sequence: Synthetic oligonucleotide
  crRNA guide nucleic acid
guugcagcgugcgcgagcguguggcuugaagg

SEQ ID NO: 836 - RNA, 32 nt, Artificial Sequence
  Description of Artificial Sequence: Synthetic oligonucleotide
  crRNA guide nucleic acid
guugcaacucgcacgugaaugcgacuugaagg

SEQ ID NO: 837 - RNA, 17 nt, Artificial Sequence
  Description of Artificial Sequence: Synthetic oligonucleotide
  sgRNA guide nucleic acid
ugaaugcgacuugaagg

SEQ ID NO: 838 - RNA, 32 nt, Artificial Sequence
  Description of Artificial Sequence: Synthetic oligonucleotide
  crRNA guide nucleic acid
gaugcaacucguguguaugugcgaguugaagg

SEQ ID NO: 839 - RNA, 32 nt, Artificial Sequence
  Description of Artificial Sequence: Synthetic oligonucleotide
  crRNA guide nucleic acid
gacgcaacucgcgcgcgggcauguauugaggg

SEQ ID NO: 840 - RNA, 32 nt, Artificial Sequence
  Description of Artificial Sequence: Synthetic oligonucleotide
  crRNA guide nucleic acid
gaugcaucugacacagcugggugaguugaagg

SEQ ID NO: 841 - RNA, 17 nt, Artificial Sequence
  Description of Artificial Sequence: Synthetic oligonucleotide
  sgRNA guide nucleic acid
gcugggugaguugaagg

SEQ ID NO: 842 - RNA, 32 nt, Artificial Sequence
  Description of Artificial Sequence: Synthetic oligonucleotide
  crRNA guide nucleic acid
guugcaacacauguaugugggugaguugaagg

SEQ ID NO: 843 - RNA, 32 nt, Artificial Sequence
  Description of Artificial Sequence: Synthetic oligonucleotide
  crRNA guide nucleic acid
guugcaauuuguauacgagugugacuugaagg

SEQ ID NO: 844 - RNA, 32 nt, Artificial Sequence
  Description of Artificial Sequence: Synthetic oligonucleotide
  crRNA guide nucleic acid
gcugcaacacgcgcggguacgcggguugaagg

SEQ ID NO: 845 - RNA, 32 nt, Artificial Sequence
  Description of Artificial Sequence: Synthetic oligonucleotide
  crRNA guide nucleic acid
guugcaacucgcacguuggcacugauugaagg

SEQ ID NO: 846 - RNA, 36 nt, Artificial Sequence
  Description of Artificial Sequence: Synthetic oligonucleotide
  crRNA guide nucleic acid
gcuguagcccugcucaaauuguagggcgcaugcagg

SEQ ID NO: 847 - RNA, 36 nt, Artificial Sequence
  Description of Artificial Sequence: Synthetic oligonucleotide
  crRNA guide nucleic acid
guuguagucgaccugaaucuguggggugcuuacagg

SEQ ID NO: 848 - RNA, 17 nt, Artificial Sequence
  Description of Artificial Sequence: Synthetic oligonucleotide
  sgRNA guide nucleic acid
uguggggugcuuacagg

SEQ ID NO: 849 - RNA, 36 nt, Artificial Sequence
  Description of Artificial Sequence: Synthetic oligonucleotide
  crRNA guide nucleic acid
gguguauguaaccgcaauuugaagggugcauacagg

SEQ ID NO: 850 - RNA, 36 nt, Artificial Sequence
  Description of Artificial Sequence: Synthetic oligonucleotide
  crRNA guide nucleic acid
guuggaaucgaccuuaauuugaggugugcuuacagg

SEQ ID NO: 851 - RNA, 36 nt, Artificial Sequence
  Description of Artificial Sequence: Synthetic oligonucleotide
  crRNA guide nucleic acid
gcugaaagagcagagaauuuguugugugcauacagg

SEQ ID NO: 852 - RNA, 36 nt, Artificial Sequence
  Description of Artificial Sequence: Synthetic oligonucleotide
  crRNA guide nucleic acid
guuggagucggcuugaaucugcggggugcuuacagg

SEQ ID NO: 853 - RNA, 36 nt, Artificial Sequence
  Description of Artificial Sequence: Synthetic oligonucleotide
  crRNA guide nucleic acid
guuguaagagacccgaauuuuagcuguguauacagg

SEQ ID NO: 854 - RNA, 36 nt, Artificial Sequence
  Description of Artificial Sequence: Synthetic oligonucleotide
  crRNA guide nucleic acid
guugugaaugcaggcauuuuugaugguaaauccaac

SEQ ID NO: 855 - RNA, 36 nt, Artificial Sequence
  Description of Artificial Sequence: Synthetic oligonucleotide
  crRNA guide nucleic acid
acugucagacaaugcaaaaugugugguacauccaac

SEQ ID NO: 856 - RNA, 10 nt, Artificial Sequence
  Description of Artificial Sequence: Synthetic oligonucleotide
  sgRNA guide nucleic acid
ugguacaucc

SEQ ID NO: 857 - RNA, 65 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuacauccaac

SEQ ID NO: 858 - RNA, 23 nt, Artificial Sequence
  Description of Artificial Sequence: Synthetic oligonucleotide
  sgRNA guide nucleic acid
ugguacauccaacucuaggcgcc

SEQ ID NO: 859 - RNA, 15 nt, Artificial Sequence
  Description of Artificial Sequence: Synthetic oligonucleotide
  sgRNA guide nucleic acid
aaugguacauccaac

SEQ ID NO: 860 - RNA, 20 nt, Artificial Sequence
  Description of Artificial Sequence: Synthetic oligonucleotide
  sgRNA guide nucleic acid
ugguacauccaacucuaggc

SEQ ID NO: 861 - RNA, 22 nt, Artificial Sequence
  Description of Artificial Sequence: Synthetic oligonucleotide
  sgRNA guide nucleic acid
ugguacauccaacucuaggcgc

SEQ ID NO: 862 - RNA, 21 nt, Artificial Sequence
  Description of Artificial Sequence: Synthetic oligonucleotide
  sgRNA guide nucleic acid
ugguacauccaacucuaggcg

SEQ ID NO: 863 - RNA, 19 nt, Artificial Sequence
  Description of Artificial Sequence: Synthetic oligonucleotide
  sgRNA guide nucleic acid
ugguacauccaacucuagg

SEQ ID NO: 864 - RNA, 16 nt, Artificial Sequence
  Description of Artificial Sequence: Synthetic oligonucleotide
  sgRNA guide nucleic acid
aaaugguacauccaac

SEQ ID NO: 865 - RNA, 16 nt, Artificial Sequence
  Description of Artificial Sequence: Synthetic oligonucleotide
  sgRNA guide nucleic acid
ugguacauccaacucu

SEQ ID NO: 866 - RNA, 15 nt, Artificial Sequence
  Description of Artificial Sequence: Synthetic oligonucleotide
  sgRNA guide nucleic acid
ugguacauccaacuc

SEQ ID NO: 867 - RNA, 14 nt, Artificial Sequence
  Description of Artificial Sequence: Synthetic oligonucleotide
  sgRNA guide nucleic acid
ugguacauccaacu

SEQ ID NO: 868 - RNA, 18 nt, Artificial Sequence
  Description of Artificial Sequence: Synthetic oligonucleotide
  sgRNA guide nucleic acid
ugguacauccaacucuag

SEQ ID NO: 869 - RNA, 13 nt, Artificial Sequence
  Description of Artificial Sequence: Synthetic oligonucleotide
  sgRNA guide nucleic acid
ugguauauccaac

SEQ ID NO: 870 - RNA, 17 nt, Artificial Sequence
  Description of Artificial Sequence: Synthetic oligonucleotide
  sgRNA guide nucleic acid
ugguacauccaacucua

SEQ ID NO: 871 - RNA, 14 nt, Artificial Sequence
  Description of Artificial Sequence: Synthetic oligonucleotide
  sgRNA guide nucleic acid
augguacauccaac

SEQ ID NO: 872 - RNA, 12 nt, Artificial Sequence
  Description of Artificial Sequence: Synthetic oligonucleotide
  sgRNA guide nucleic acid
ugguacauccaa

SEQ ID NO: 873 - RNA, 11 nt, Artificial Sequence
  Description of Artificial Sequence: Synthetic oligonucleotide
  sgRNA guide nucleic acid
ugguacaucca

SEQ ID NO: 874 - RNA, 36 nt, Artificial Sequence
  Description of Artificial Sequence: Synthetic oligonucleotide
  crRNA guide nucleic acid
gcugucaguaguaguaaaaauggggguacauccaac

SEQ ID NO: 875 - RNA, 36 nt, Artificial Sequence
  Description of Artificial Sequence: Synthetic oligonucleotide
  crRNA guide nucleic acid
acugucaguacaugcaaaaaugaggguacauccaac

SEQ ID NO: 876 - RNA, 36 nt, Artificial Sequence
  Description of Artificial Sequence: Synthetic oligonucleotide
  crRNA guide nucleic acid
acugucagacaaugcaaaaugagugguacauccaac

SEQ ID NO: 877 - RNA, 36 nt, Artificial Sequence
  Description of Artificial Sequence: Synthetic oligonucleotide
  crRNA guide nucleic acid
gcuguuagaacauacaaaaugaaagguacauccaac

SEQ ID NO: 878 - RNA, 36 nt, Artificial Sequence
  Description of Artificial Sequence: Synthetic oligonucleotide
  crRNA guide nucleic acid
gcugcaugucauggcaaaaggaaagguacauccaac

SEQ ID NO: 879 - RNA, 36 nt, Artificial Sequence
  Description of Artificial Sequence: Synthetic oligonucleotide
  crRNA guide nucleic acid
gcugucagacaccuaaaaaaugaggguacauccaac

SEQ ID NO: 880 - RNA, 36 nt, Artificial Sequence
  Description of Artificial Sequence: Synthetic oligonucleotide
  crRNA guide nucleic acid
gcugugagucacaguaaaaaugaagguauauccaac

SEQ ID NO: 881 - RNA, 36 nt, Artificial Sequence
  Description of Artificial Sequence: Synthetic oligonucleotide
  crRNA guide nucleic acid
gauguauaugcuaugauuuuguaugguacauccaac

SEQ ID NO: 882 - RNA, 37 nt, Artificial Sequence
  Description of Artificial Sequence: Synthetic oligonucleotide
  crRNA guide nucleic acid
guugcagaacccgaauagacgaaugaaggaaugcaac

SEQ ID NO: 883 - RNA, 33 nt, Artificial Sequence
  Description of Artificial Sequence: Synthetic oligonucleotide
  crRNA guide nucleic acid
guugagcucugcauuacgcagaugaaugacgag

SEQ ID NO: 884 - RNA, 32 nt, Artificial Sequence
  Description of Artificial Sequence: Synthetic oligonucleotide
  crRNA guide nucleic acid
gauauaucuuguaugcauauguagguugugag

SEQ ID NO: 885 - RNA, 33 nt, Artificial Sequence
  Description of Artificial Sequence: Synthetic oligonucleotide
  crRNA guide nucleic acid
guugcaacuuacgcauagguguaaaauacgagg

SEQ ID NO: 886 - RNA, 32 nt, Artificial Sequence
  Description of Artificial Sequence: Synthetic oligonucleotide
  crRNA guide nucleic acid
gaugcaacuuagaugcauauguaaguugugag

SEQ ID NO: 887 - RNA, 32 nt, Artificial Sequence
  Description of Artificial Sequence: Synthetic oligonucleotide
  crRNA guide nucleic acid
guugcaaugaacguaugugcaugaggugugag

SEQ ID NO: 888 - RNA, 32 nt, Artificial Sequence
  Description of Artificial Sequence: Synthetic oligonucleotide
  sgRNA guide nucleic acid
guugcaauucguaugcgcagguaaguuucgag

SEQ ID NO: 889 - RNA, 17 nt, Artificial Sequence
  Description of Artificial Sequence: Synthetic oligonucleotide
  sgRNA guide nucleic acid
ugugcaugaggugugag

SEQ ID NO: 890 - RNA, 32 nt, Artificial Sequence
  Description of Artificial Sequence: Synthetic oligonucleotide
  crRNA guide nucleic acid
guugcaaucugcguacaggcguaagaugugag

SEQ ID NO: 891 - RNA, 17 nt, Artificial Sequence
  Description of Artificial Sequence: Synthetic oligonucleotide
  sgRNA guide nucleic acid
caggcguaagaugugag

SEQ ID NO: 892 - RNA, 32 nt, Artificial Sequence
  Description of Artificial Sequence: Synthetic oligonucleotide
  crRNA guide nucleic acid
gaucauaucugcuuguauggguaugcugcgag

SEQ ID NO: 893 - RNA, 17 nt, Artificial Sequence
  Description of Artificial Sequence: Synthetic oligonucleotide
  sgRNA guide nucleic acid
uauggguaugcugcgag

SEQ ID NO: 894 - RNA, 32 nt, Artificial Sequence
  Description of Artificial Sequence: Synthetic oligonucleotide
  crRNA guide nucleic acid
guugcaacuuacgcauagguguaaaauacgag

SEQ ID NO: 895 - RNA, 32 nt, Artificial Sequence
  Description of Artificial Sequence: Synthetic oligonucleotide
  crRNA guide nucleic acid
gauuauaucugcuuguauggguauacugcgag

SEQ ID NO: 896 - RNA, 38 nt, Artificial Sequence
  Description of Artificial Sequence: Synthetic oligonucleotide
  crRNA guide nucleic acid
ucagcucacaaccuacauaugcauacaagauauaucgu

SEQ ID NO: 897 - RNA, 17 nt, Artificial Sequence
  Description of Artificial Sequence: Synthetic oligonucleotide
  sgRNA guide nucleic acid
cauauguagguugugag

SEQ ID NO: 898 - RNA, 13 nt, Artificial Sequence
  Description of Artificial Sequence: Synthetic oligonucleotide
  sgRNA guide nucleic acid
uguagguugugag

SEQ ID NO: 899 - RNA, 13 nt, Artificial Sequence
  Description of Artificial Sequence: Synthetic oligonucleotide
  sgRNA guide nucleic acid
caugaggugugag

SEQ ID NO: 900 - RNA, 17 nt, Artificial Sequence
  Description of Artificial Sequence: Synthetic oligonucleotide
  sgRNA guide nucleic acid
ugcgguguaauucgagg

SEQ ID NO: 901 - RNA, 36 nt, Artificial Sequence
  Description of Artificial Sequence: Synthetic oligonucleotide
  crRNA guide nucleic acid
gaugugaacgaccuuuuuuugcggugugcuucgagg

SEQ ID NO: 902 - RNA, 36 nt, Artificial Sequence
  Description of Artificial Sequence: Synthetic oligonucleotide
  crRNA guide nucleic acid
gguggauaucaucuuaaaaagugagguacauccaac

SEQ ID NO: 903 - RNA, 36 nt, Artificial Sequence
  Description of Artificial Sequence: Synthetic oligonucleotide
  crRNA guide nucleic acid
ggugugaacgaccuuuuuuugcgguguaauucgagg

SEQ ID NO: 904 - RNA, 18 nt, Artificial Sequence
  Description of Artificial Sequence: Synthetic oligonucleotide
  sgRNA guide nucleic acid
uugcgguguacuucgagg

SEQ ID NO: 905 - RNA, 17 nt, Artificial Sequence
  Description of Artificial Sequence: Synthetic oligonucleotide
  sgRNA guide nucleic acid
agaagaaggauugggac

SEQ ID NO: 906 - RNA, 36 nt, Artificial Sequence
  Description of Artificial Sequence: Synthetic oligonucleotide
  crRNA guide nucleic acid
aaugugaacgaccuucuuuugcgguguacuucgagg

SEQ ID NO: 907 - RNA, 14 nt, Artificial Sequence
  Description of Artificial Sequence: Synthetic oligonucleotide
  sgRNA guide nucleic acid
aagguugauacagc

SEQ ID NO: 908 - RNA, 36 nt, Artificial Sequence
  Description of Artificial Sequence: Synthetic oligonucleotide
  crRNA guide nucleic acid
gcuguaagucauggaaaaauggugaguacauccaac

SEQ ID NO: 909 - RNA, 18 nt, Artificial Sequence
  Description of Artificial Sequence: Synthetic oligonucleotide
  sgRNA guide nucleic acid
auggugaguacauccaac

SEQ ID NO: 910 - RNA, 13 nt, Artificial Sequence
  Description of Artificial Sequence: Synthetic oligonucleotide
  sgRNA guide nucleic acid
gagcacauccaac

SEQ ID NO: 911 - RNA, 13 nt, Artificial Sequence
  Description of Artificial Sequence: Synthetic oligonucleotide
  sgRNA guide nucleic acid
ggguacauccaac

SEQ ID NO: 912 - RNA, 36 nt, Artificial Sequence
  Description of Artificial Sequence: Synthetic oligonucleotide
  crRNA guide nucleic acid
guugcguuugcccgugauuucggguguguauacagg

SEQ ID NO: 913 - RNA, 13 nt, Artificial Sequence
  Description of Artificial Sequence: Synthetic oligonucleotide
  sgRNA guide nucleic acid
agguauauccaac

SEQ ID NO: 914 - RNA, 36 nt, Artificial Sequence
  Description of Artificial Sequence: Synthetic oligonucleotide
  crRNA guide nucleic acid
ggcguaugucuaccugaaaaagaagguauauccaac

SEQ ID NO: 915 - RNA, 13 nt, Artificial Sequence
  Description of Artificial Sequence: Synthetic oligonucleotide
  sgRNA guide nucleic acid
ggcuacauacagc

SEQ ID NO: 916 - RNA, 36 nt, Artificial Sequence
  Description of Artificial Sequence: Synthetic oligonucleotide
  crRNA guide nucleic acid
gguguaugugcaccauauauguaggugacauacagc

SEQ ID NO: 917 - RNA, 17 nt, Artificial Sequence
  Description of Artificial Sequence: Synthetic oligonucleotide
  sgRNA guide nucleic acid
aaaacaaggauugaaac

SEQ ID NO: 918 - RNA, 36 nt, Artificial Sequence
  Description of Artificial Sequence: Synthetic oligonucleotide
  crRNA guide nucleic acid
gaugugaacgaccuuuuuuugcgguguacuucgagg

SEQ ID NO: 919 - RNA, 13 nt, Artificial Sequence
  Description of Artificial Sequence: Synthetic oligonucleotide
  sgRNA guide nucleic acid
guguacuucgagg

SEQ ID NO: 920 - RNA, 36 nt, Artificial Sequence
  Description of Artificial Sequence: Synthetic oligonucleotide
  crRNA guide nucleic acid
gauguaaaucaucuauaaaagaaagguacauccaac

SEQ ID NO: 921 - RNA, 12 nt, Artificial Sequence
  Description of Artificial Sequence: Synthetic oligonucleotide
  sgRNA guide nucleic acid
gguacauccaac

SEQ ID NO: 922 - RNA, 17 nt, Artificial Sequence
  Description of Artificial Sequence: Synthetic oligonucleotide
  sgRNA guide nucleic acid
cguacguggauugaaac

SEQ ID NO: 923 - RNA, 36 nt, Artificial Sequence
  Description of Artificial Sequence: Synthetic oligonucleotide
  crRNA guide nucleic acid
gcugcacugcaccgcccauugauggugugcucuagg

SEQ ID NO: 924 - RNA, 36 nt, Artificial Sequence
  Description of Artificial Sequence: Synthetic oligonucleotide
  crRNA guide nucleic acid
auuguaggcgaccuuuuuuugcgauguaguucgagg

SEQ ID NO: 925 - RNA, 13 nt, Artificial Sequence
  Description of Artificial Sequence: Synthetic oligonucleotide
  sgRNA guide nucleic acid
auguaguucgagg

SEQ ID NO: 926 - RNA, 36 nt, Artificial Sequence
  Description of Artificial Sequence: Synthetic oligonucleotide
  crRNA guide nucleic acid
aguguaugauuaccuguaguaugagguacauccaac

SEQ ID NO: 927 - RNA, 36 nt, Artificial Sequence
  Description of Artificial Sequence: Synthetic oligonucleotide
  sgRNA guide nucleic acid
gcugcaagagcuccuaauuugaggggugcauacagg

SEQ ID NO: 928 - RNA, 36 nt, Artificial Sequence
  Description of Artificial Sequence: Synthetic oligonucleotide
  crRNA guide nucleic acid
gauaguuuuaacuuccauuugaaauguaaaugcaac

SEQ ID NO: 929 - RNA, 13 nt, Artificial Sequence
  Description of Artificial Sequence: Synthetic oligonucleotide
  sgRNA guide nucleic acid
auguaaaugcaac

SEQ ID NO: 930 - DNA, 4 bp, Artificial Sequence
  Description of Artificial Sequence: Synthetic oligonucleotide
tttc

SEQ ID NO: 931 - DNA, 4 bp, Artificial Sequence
  Description of Artificial Sequence: Synthetic oligonucleotide
wttr

SEQ ID NO: 932 - RNA, 78 nt, Artificial Sequence
  Description of Artificial Sequence: Synthetic oligonucleotide
  sgRNA guide nucleic acid
uggggcaguugguugcccuuagccugaggcauuuauugcacucgggaaguaccauuucucagaaaugguauauccaac

SEQ ID NO: 933 - RNA, 55 nt, Artificial Sequence
  Description of Artificial Sequence: Synthetic oligonucleotide
  sgRNA guide nucleic acid
auggggcaguugguugcccuuagccugaggcauuuaaugcacucgggagaaaaac

SEQ ID NO: 934 - RNA, 65 nt, Artificial Sequence
  Description of Artificial Sequence: Synthetic oligonucleotide
  sgRNA guide nucleic acid
auggggcaguugguugcccuuagccugaggcauuuaaugcacucgggaaguaccgaaaauccaac

SEQ ID NO: 935 - RNA, 79 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaagguacauccaac

SEQ ID NO: 936 - RNA, 71 nt, Artificial Sequence
  Description of Artificial Sequence: Synthetic oligonucleotide
  sgRNA guide nucleic acid
auggggcaguugguugcccuuagccugaggcauuuaaugcacucgggaaguaccuuuucucagaaaccaac

SEQ ID NO: 937 - RNA, 136 nt, Artificial Sequence
  Description of Artificial Sequence: Synthetic polynucleotide
  sgRNA guide nucleic acid
uuauuagaaaugaaauauuuucuaaugggguuguuggaaagagcuuuuacugaaauuuguaaaggugcccugaacuugagaauugaaaaauuacucgaggaaaugguacauccaacuauuaaauacucguauugcu

SEQ ID NO: 938 - RNA, 189 nt, Artificial Sequence
  Description of Artificial Sequence: Synthetic polynucleotide
  tracrRNA guide nucleic acid
cgauuccucccuacaguaguuagguauagccgaaagguagagacuaaaucuguaguuggagugggccgcuugcaucggccuaaaguugagaagugucagacucugauaacccucaacgacgauauucuuuauuucgguucaaaguucugcacaaaacaggugaguccuuauaaaccggugugcagaacg

SEQ ID NO: 939 - RNA, 189 nt, Artificial Sequence; identical to SEQ ID NO: 938
  Description of Artificial Sequence: Synthetic polynucleotide
  tracrRNA guide nucleic acid

SEQ ID NO: 940 - RNA, 189 nt, Artificial Sequence; identical to SEQ ID NO: 938
  Description of Artificial Sequence: Synthetic polynucleotide
  tracrRNA guide nucleic acid

SEQ ID NO: 941 - RNA, 97 nt, Artificial Sequence
  Description of Artificial Sequence: Synthetic oligonucleotide
  guide nucleic acid
augaauaggauucguccuauggggcaguugguugcccuuagccugaggcauuuauugcacucgggaaguaccauuucucagaaaugguacauccaac

SEQ ID NO: 942 - RNA, 10 nt, Artificial Sequence
  Description of Artificial Sequence: Synthetic oligonucleotide
  guide nucleic acid
ugguacaucc

SEQ ID NO: 943 - RNA, 10 nt, Artificial Sequence
  Description of Artificial Sequence: Synthetic oligonucleotide
  guide nucleic acid
ugguauaucc

SEQ ID NO: 944 - protein, 6 aa, Artificial Sequence
  Description of Artificial Sequence: Synthetic peptide
HHHHHH

SEQ ID NO: 945 - DNA, 20 bp, Artificial Sequence
  Description of Artificial Sequence: Synthetic oligonucleotide
  misc_feature (1)..(20): This sequence may encompass 5-20 nucleotides
aaaaaaaaaaaaaaaaaaaa

SEQ ID NO: 946 - DNA, 20 bp, Artificial Sequence
  Description of Artificial Sequence: Synthetic oligonucleotide
  misc_feature (1)..(20): This sequence may encompass 5-20 nucleotides
tttttttttttttttttttt

SEQ ID NO: 947 - DNA, 20 bp, Artificial Sequence
  Description of Artificial Sequence: Synthetic oligonucleotide
  misc_feature (1)..(20): This sequence may encompass 5-20 nucleotides
cccccccccccccccccccc

SEQ ID NO: 948 - DNA, 20 bp, Artificial Sequence
  Description of Artificial Sequence: Synthetic oligonucleotide
  misc_feature (1)..(20): This sequence may encompass 5-20 nucleotides
gggggggggggggggggggg

SEQ ID NO: 949 - protein, 50 aa, Artificial Sequence
  Description of Artificial Sequence: Synthetic polypeptide
KEFVLRNWSYYELQNMIEYKAKEYGIKVVKINPAYTSQRCSWCGYIGKRN

SEQ ID NO: 950 - protein, 29 aa, Artificial Sequence
  Description of Artificial Sequence: Synthetic peptide
TQNHLYSREVIDFAVKNGAGTIQMEDLSG

SEQ ID NO: 951 - protein, 21 aa, Artificial Sequence
  Description of Artificial Sequence: Synthetic peptide
LBKNIVVGVDLGINVPLYAAT

SEQ ID NO: 952 - protein, 41 aa, Artificial Sequence
  Description of Artificial Sequence: Synthetic polypeptide
QWGLLYHINDNLYKAANNISSKLYLDEHVSSMVRLKHAEYL

SEQ ID NO: 953 - protein, 21 aa, Artificial Sequence
  Description of Artificial Sequence: Synthetic peptide
  MOD_RES (8)..(8): L or I
VLRGERSXPTYKKGMPIPFHW

SEQ ID NO: 954 - protein, 15 aa, Artificial Sequence
  Description of Artificial Sequence: Synthetic peptide
NADYNAARNIAISKI

SEQ ID NO: 955 - protein, 23 aa, Artificial Sequence
  Description of Artificial Sequence: Synthetic peptide
RLKGTRGGHGRKKKLEPLERLRD

SEQ ID NO: 956 - DNA, 11 bp, Artificial Sequence
  Description of Artificial Sequence: Synthetic oligonucleotide
tattatgaccg

SEQ ID NO: 957 - DNA, 12 bp, Artificial Sequence
  Description of Artificial Sequence: Synthetic oligonucleotide
tgctgttcgaaa

SEQ ID NO: 958 - DNA, 20 bp, Artificial Sequence
  Description of Artificial Sequence: Synthetic oligonucleotide
cagctctcagccaccttccc

What is claimed is:

1. A system comprising components for detecting or modifying a target nucleic acid, wherein the components comprise:
   a) a polypeptide, or a nucleic acid encoding the polypeptide, wherein the polypeptide comprises an amino acid sequence that is at least 90% identical to SEQ ID NO:23; and
   b) an engineered guide nucleic acid, or a nucleic acid encoding the engineered guide nucleic acid, wherein the engineered guide nucleic acid comprises a spacer sequence that is at least 90% complementary to a target sequence comprised by the target nucleic acid,
   wherein the polypeptide (i) binds to the engineered guide nucleic acid and (ii) comprises nuclease activity.

2. The system of claim 1, wherein the polypeptide comprises reduced nuclease activity relative to the nuclease activity of a polypeptide consisting of an amino acid sequence that is 100% identical to SEQ ID NO:23.

3. The system of claim 1, wherein the polypeptide comprises an amino acid sequence that is at least 95% identical to the sequence of SEQ ID NO: 23.

4. The system of claim 1, wherein the polypeptide comprises the sequence of SEQ ID NO: 23.

5. The system of claim 1, wherein the engineered guide nucleic acid comprises a nucleotide sequence that is at least 85% identical to a sequence selected from: SEQ ID NO: 624, 628, 630, 634, 638, 641, 643, and 645.

6. The system of claim 1, wherein the engineered guide nucleic acid comprises a nucleotide sequence that is at least 95% identical to a sequence selected from: SEQ ID NO: 624, 628, 630, 634, 638, 641, 643, and 645.

7. The system of claim 2, wherein the polypeptide comprises a fusion partner.

8. The system of claim 1, wherein the polypeptide is capable of cleaving at least one strand of the target nucleic acid, and wherein the target nucleic acid comprises double stranded DNA (dsDNA).

9. The system of claim 8, wherein the polypeptide is capable of cleaving both strands of the target nucleic acid.

10. The system of claim 9, wherein the components further comprise at least one of:
    a) a detection reagent, wherein the detection reagent is selected from a reporter nucleic acid, a detection moiety, an additional polypeptide, and any combination thereof; and
    b) an amplification reagent, wherein the amplification reagent is selected from a primer, a polymerase, a dNTP, an rNTP, and any combination thereof.

11. The system of claim 1, wherein the target nucleic acid comprises a target sequence and the target sequence is adjacent to a protospacer adjacent motif (PAM) selected from the sequence of any one of SEQ ID NO: 156-159, 325-328, and 369.

12. The system of claim 11, wherein the PAM sequence is the sequence of SEQ ID NO: 369.

13. The system of claim 1, wherein the nucleic acid encoding the polypeptide and the nucleic acid encoding the engineered guide nucleic acid are in a single expression vector.

14. The system of claim 13, wherein the expression vector is an adeno-associated viral vector.

15. The system of claim 1, wherein the nucleic acid encoding the polypeptide is a messenger RNA.

16. The system of claim 1, further comprising a lipid or lipid nanoparticle.

17. The system of claim 1, wherein the spacer sequence is 100% complementary to the target sequence comprised by the target nucleic acid.

18. The system of claim 1, wherein the engineered guide nucleic acid comprises at least 10 contiguous nucleotides that are complementary to the target nucleic acid, and wherein the target nucleic acid is a eukaryotic nucleic acid.

19. The system of claim 1, wherein the polypeptide is fused to at least one nuclear localization signal.

20. A composition for modifying a target nucleic acid, said composition comprising:
    a) a polypeptide, or a nucleic acid encoding the polypeptide, wherein the polypeptide comprises an amino acid sequence that is at least 90% identical to SEQ ID NO:23; and
    b) an engineered guide nucleic acid, or a nucleic acid encoding the engineered guide nucleic acid, wherein the engineered guide nucleic acid comprises a spacer sequence that is at least 90% complementary to a target sequence comprised by the target nucleic acid,
    wherein the polypeptide (i) binds to the engineered guide nucleic acid and (ii) comprises nuclease activity.

21. The composition of claim 20, wherein the polypeptide comprises an amino acid sequence that is at least 95% identical to the sequence of SEQ ID NO: 23.

22. The composition of claim 20, wherein the engineered guide nucleic acid comprises a sequence that is at least 85% identical to a sequence selected from: SEQ ID NO: 624, 628, 630, 634, 638, 641, 643, and 645.

23. The composition of claim 20, wherein the polypeptide comprises reduced nuclease activity relative to the nuclease activity of a polypeptide consisting of an amino acid sequence that is 100% identical to SEQ ID NO:23.

24. The composition of claim 23, wherein the polypeptide comprises a fusion partner.

25. The composition of claim 24, wherein the fusion partner is selected from a reverse transcriptase, a methylase, a transcriptional activator, and a deaminase.

26. The composition of claim 20, wherein the polypeptide is capable of cleaving at least one strand of the target nucleic acid, and wherein the target nucleic acid comprises double stranded DNA (dsDNA).

27. The composition of claim 26, wherein the target nucleic acid comprises a target sequence and the target sequence is adjacent to a PAM sequence selected from any one of SEQ ID NO: 156-159, 325-328, and 369.

28. The system of claim 1, wherein the components further comprise a donor nucleic acid.

29. The composition of claim 20, wherein the polypeptide or the nucleic acid encoding the polypeptide and the engineered guide nucleic acid or the nucleic acid encoding the engineered guide nucleic acid are in a solution.

30. The composition of claim 26, wherein the polypeptide is capable of cleaving both strands of the target nucleic acid.

* * * * *